United States Patent 7,745,391 (HUMAN THROMBOSPONDIN POLYPEPTIDE) - sequence listing, part 30

SEQ ID NO: 69519 - DNA, 636 bp, Homo sapiens
  misc_feature (1)..(1): n is a, c, g, or t
  misc_feature (11)..(13): n is a, c, g, or t
  misc_feature (46)..(46): n is a, c, g, or t
  misc_feature (51)..(51): n is a, c, g, or t
  misc_feature (53)..(53): n is a, c, g, or t
naagtagagannnaaccccgagaccagagcccggggccttaacggnaaccngnggtccccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaaagtcgacgaaaacaacggttggggcgcgggccgaaaagcttaaaccacgcgtgcggccggccaaggaaagaagggcccgtgccggagccgggagacggggtccccaaaagcggcgggccgcgcgcaccagggcctgggcctcgctcccggcgcgagcacccccgcggcgcgggacacgacccagccaaagcggcggcaaccaaagcgac

SEQ ID NO: 69520 - DNA, 540 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttctttgcttatatgttaatagttttaccctctgcattggagagaggagtgctttactccaagaagctttcctcatggttaccgttctctccat

SEQ ID NO: 69521 - DNA, 1054 bp, Homo sapiens
gactctgggtccatcttcaagacactgggctgtggatcaacccaaccaccactcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69522 - DNA, 1078 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaaagtcgacgaaaacaacggttggggcgcgggccgaaaagcttaaaccacgcgtgcggccggccaaggaaagaagggcccgtgccggagccgggagacggggtccccaaaagcggcgggccgcgcgcaccagggcctgggcctcgctcccggcgcgagcacccccgcggcgcgggacacgacccagccaaagcggcggcaaccaaagcgac

SEQ ID NO: 69523 - DNA, 857 bp, Homo sapiens
gactcgactcagggaccggagcagccctcaactcactcttcagcttccctgctgtgttgcagcccagccgctccatcatgtccttcagtgctgaccagattgctgatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69524 - DNA, 773 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaacaccctgaatttttatacatcttcagtttttctctgaattgaattcataccacacaaacaaagtgtctgctgctctagatgagaagaataaaatattgacaatctc

SEQ ID NO: 69525 - DNA, 867 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagctttgtcaagcacatcatgtctatctgaatggagctctcagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69526 - DNA, 460 bp, Homo sapiens
  misc_feature (422)..(422): n is a, c, g, or t
gactcgactcagggaccggagcagccctcaactcactcttcagcttccctgctgtgttgcagcccagccgctccatcatgcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaatccctgaattttatacatcttcagttttctctgaattgattctaccacacaacaaggtctgtgtctagatgagaagataaatttggcattctcaatccagccatttttttttccggtcccacttttacatatctacacttggcgccaaaaaaaaaaaagtggggccccgaataaangggccgaaatatcacaaaaggtcaacccggggtaccag

SEQ ID NO: 69527 - DNA, 672 bp, Homo sapiens
acagttccatggatcctgttcctttgttggtagacatttggcttttcacagggttccttctgctgcaataaattccagaaaacacagacatgtttctgttgcatagattaagaaatggcattgtattgtcagagtgtctgcacttgggtcctaatggatgttacctgtccttcctccaccacagctgccttcgtaacaaccagtgtgactacgtcagagctcctcatgttcttgcatggcccaaggtgaggtctaggaattcaggccaagtgagcagaggttgggtggcctggggattgaacttgggcttccggttctgctgatctcccagctccctcctgcacttcctctcggccaagggcaagatcctagagaaggccctcacacagactgacctaggatcctgaaaacaaagccctaagaggaaatccttaagtgtcataatcttcagcctcatcatcttccctgtatttttgttccaatagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69528 - DNA, 1918 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69529 - DNA, 2158 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaaggtgaggtctaggaattcaggccaagtgagcagaggttgggtggcctggggattgaacttgggcttccggttctgctgatctcccagctccctcctgcacttcctctcggccaagggcaagatcctagagaaggccctcacacagactgacctaggatcctgaaaacaaagccctaagaggaaatccttaagtgtcataatcttcagcctcatcatcttccctgtatttttgttccaatagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69530 - DNA, 1822 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatggtacaggttttctctgcccagtctgggggatgaactaccagttgcctcagaagtgagtgctgggccgggcgcggtggctcacgcctgtaatcccagcactttgggaggccgaggcgggcgaatcacgaggtcaggagattgagaccatcctg

SEQ ID NO: 69531 - DNA, 2333 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaagtcagttgtaccctctgtcaccacctgggaccctgacctgtgtttgatagcgcccttctgcaggaggaggcagcactagtcttctgggaggaccacagaccctctccttccccctcgccccactcctctctctgtgtcactcattcatctgtgcttagacatctcctttccttcctctgacatggtccccttttcacccgctctgggatgtgtttcccacctgtctccacccagcctcctctagcgtgccctctgacgtaggtgtgattgctcccatgaggaggacagctccacagtttcacttaccgttgtccattttgttttgattttcggcagctccatcctggaattgttccccaaattattatgcctggatggccagcagtcacccagagcaactttatgtggtactgaagcccacaagaggttaccaacctgtaaggtgagaagagaggatccagcagggtggtgcatgaggaagggggggtaccatctgtggtcctggggactctttattccagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69532 - DNA, 2254 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaagtcagttgtaccctctgtcaccacctgggaccctgacctgtgtttgatagcgcccttctgcaggaggaggcagcactagtcttctgggaggaccacagaccctctccttccccctcgccccactcctctctctgtgtcactcattcatctgtgcttagacatctcctttccttcctctgacatggtccccttttcacccgctctgggatgtgtttcccacctgtctccacccagcctcctctagcgtgccctctgacgtaggtgtgattgctcccatgaggaggacagctccacagtttcacttaccgttgtccattttgttttgattttcggcagctccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69533 - DNA, 1064 bp, Homo sapiens
gaacttcggagtgtaggtggacacactgcactgtgtctctgacgtaggtgtgattgctcccatgaggaggacagctccacagtttcacttaccgttgtccattttgttttgattttcggcagctccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69534 - DNA, 1251 bp, Homo sapiens
cagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaagtcagttgtaccctctgtcaccacctgggaccctgacctgtgtttgatagcgcccttctgcaggaggaggcagcactagtcttctgggaggaccacagaccctctccttccccctcgccccactcctctctctgtgtcactcattcatctgtgcttagacatctcctttccttcctctgacatggtccccttttcacccgctctgggatgtgtttcccacctgtctccacccagcctcctctagcgtgccctctgtgagtgtgctccaggaagcg

SEQ ID NO: 69535 - DNA, 1011 bp, Homo sapiens
taggtccagggccatgtgactcccctgcagaaagacaccagctcctggagatgcctgcactggccagaccacccactcctgctcctctttttcttctaggagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaaggtgaggtctaggaattcaggccaagtgagcagaggttgggtggcctggggattgaacttgggcttccggttctgctgatctcccagctccctcctgcacttcctctcggccaagggcaagatcctagagaaggccctcacacagactgacctaggatcctgaaaacaaagccctaagaggaaatccttaagtgtcataatcttcagcctcatcatcttccctgtatttttgttccaatagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgc

SEQ ID NO: 69536 - DNA, 256 bp, Homo sapiens
aggcaagagaaggctaggtcagatgaatttacccaagtacaagtctgcctacagtcagactttcaagactcatttggcacccaggccacagagatagcctgtcctcactggtctccaacaggtattacttgatctatgactctggagatcgacagggtctccttagtgcttaccacgatgaggcctgcttctccctgagcattcccttcaatcctgaggactcagccccgtgagtatcacagctccgaccctaggt

SEQ ID NO: 69537 - DNA, 132 bp, Homo sapiens
gctaagttcatggatatcaatttaaggatatttttccaattttctatgtgtacatatgtagaatgcacacaaacaactgaatattcaaacattagtgcagactctattatatgatatccattatatgtatat

SEQ ID NO: 69538 - DNA, 1283 bp, Homo sapiens
gtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtgaatataggaagaccttttagcaaagatgcaggccagtttgtttattagactttatactgtagagaaatcatatgaagaccataaatgtgggaaagcctttgtcagtattaatcccttaattgacataagtatactcacactaggataaaaccctgtacatgtagcaaatgtgggaaagactatagacaataggaatcttttacaaactcctacaggagagaagctgtatgaatgtagaaaatttagaaattgagggaagtcttcagttccaagtatatcccttattctacagcagagaactcaaaatggagagaaatctcatttaagagatgtagcaaagtgttcactaagagtgtttatcttggtacacatcagaagattaatggtagaacaacctgaaggatttaggagttatgtgtaaatctttgcagtcatgctatttgtaaactggattctacaggagagcaaataaacattataataaaatatgcatttcttagagcagtagcttgcagtttcagttgagttctacttagaaattctttttagctagtgggcatgtgaagatatttagtcacccagaggagccagtaagtgttataatattgaaaattaaagctgcaaaagaaataaagtgatgttaataaaagttttggcatctaataaaatcattttgtatatcaaaaactctttcactgtgactattt

SEQ ID NO: 69539 - DNA, 636 bp, Homo sapiens
gcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgttt

SEQ ID NO: 69540 - DNA, 309 bp, Homo sapiens
tggagttatgaagatagtgtatgaataaaaagcctaggcatccttagaagtacgttttaaaaaggagaatagggccttggaaaagcacagagttgagtctatcagagaaggcttcctggtggaagcagaatgtcatagagacaggagatagatgagcaagagggcactcatgaggtatgaggcggttggtaggttatcttgattaaagaatcaggttgtaaataagttactgttaagtacatatgtactagtatgtactagagcgtggcgtttgtgaccaagattatgtgggctgctgtatggagaagg

SEQ ID NO: 69541 - DNA, 167 bp, Homo sapiens
tgaacttttcgtaactgaagctagttcttataggcctcattagattcaggctcaatatttttcacaggagccaaaataggtggagctatgtagtctactccatcctattaggggtgagaaaagaactttctttcttttttttttttttttttagacggagtcttgct

SEQ ID NO: 69542 - DNA, 284 bp, Homo sapiens
cgggacaggctgaggcaggagaatggcgtgaacccgggaggcggagcttgcagtgagctgagatcgcgccactgcactccagcctgggtgacacagcgagacttcgtctcaaacaaacaaacaaaaaaaaaaacaaattcaaaaaatatataatgaaattaactttcccaaagctcaacgtactttataaattagaagtgataggccaaacactaaagcacaggattctgggaatgcttaatagacactaacaaccatacaattgcacactcttacagcaaaat

SEQ ID NO: 69543 - DNA, 1853 bp, Homo sapiens
gggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaatggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacctaattgtttgtacttctatttaccctcatgcctcctccacaaagtgtttcagtggaatggactctcttttagcagataaaccatatatgcaaaagtacaatgtaaaagtggagaccatatcagatgaccacgcagacaaattggtaagggcaaatctctctgctcccattctaagttatttttggaattttaacccctttgcatccaaactcatgtttatttactttgacttagaataggcaaaacaaacaacaaaaaccagcttctcccaattggcaactaactctataatctgtttgacatttcaatcttaatatattaacttcatctcttttaaaaatgttttcgttattaatattcctcttcataagtgctttaattctcactggcttcaagggaccaattgtgctctttgtgggcagggttcacctagacatttgcaaaataagcaaatagatctttccacttttggagat

SEQ ID NO: 69544 - DNA, 871 bp, Homo sapiens
  misc_feature (796)..(796): n is a, c, g, or t
gggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatattcaacagatgatggtggggtataaaactgatctaactcagatatttcttcactggttgtacttcccacacncaatggaaatgtcagactcaggagaaagtgacgacctagtatcctgtttctagttgtagtattataccgtgtagt

SEQ ID NO: 69545 - DNA, 828 bp, Homo sapiens
gttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctagtttttgtatttttagtagagatgaggtttcaccatgttggccaggctggtcttgaactcctgacctcgtgatccccccac

SEQ ID NO: 69546 - DNA, 392 bp, Homo sapiens
tgggagccaggcatttggcccattgcccagttgatagcaggggctgagttggggaatgttccatcctctgtggttaatctattctgagcaggttttggggctttgtaaccatgtgaattttgtatctttgttggtgaataatttaccaaatactgttatgttgttatataatataaaacttactcttcatcttttatttttagatacttggagagaaataccaaagtaatgttcctcactcagtaacactggttggaaggatatgcgatgacttgttgctctctatgaggttttgtttttttgtttgttttttgagactgagtctgcactccagcctgggtgcagagggagaccctgtctccaaaaagaaaaaatgaaaaaaaaacacatac

SEQ ID NO: 69547 - DNA, 259 bp, Homo sapiens
aataacactgtcacgtccacttttgtaagtctccccacctcccagggccctaaatttcttgaatatccttcctacagcatttgatacatatgcaggcatacactcccttttttttgttttttgagacggagttttgctcttgttgcctaggctggagtgcaatggcatgatctcagcttattgcaacctctgcctcccagattcaagcgattctcctgccacagcctccggagtagctgggattataggtgcccaacac

SEQ ID NO: 69548 - DNA, 401 bp, Homo sapiens
gaaatggacttcatttagaagatggtgtgtgtgtgtgtgtgtgtgtatttacacgtgtatacctttgtacagaaatttcctccacaaaattcctgctagatgaagtcatctctgttgataaatgtgatgaactgttgattttgttaatgaaatcggattcagcttggtttctcttctcctgcagatgtgcttggtccagcagtattcccctgggaactgttctccaggcgctgcagagctcctctgtgctgtctgtatccacctgtggtctgtttccgggctctctttcatgtcacattgacctgtttttgtatcttatgccagtcttttttcttttatttatttatttatattattattttttttgatggagcctgggcgacagagattccatctcaaaa

SEQ ID NO: 69549 - DNA, 340 bp, Homo sapiens
tgcttctctcatcaggtactgtgctattagtacttaaagccttgatacctgacttcgcaggaagatgggtcagaaatgccaatctaccagcttgttacttttcttagtttctcacattgctttccagctgtgtcctctaagttgaatgatgtctgcctcccaccacaacaggagactcatttcactttagaaggagttatttgagtcttaaaaccttataaattgctgggtacagtggctcacacctgtaatccaagcactttgggaggccgaggcaggcagatcacttgaggccaggagtttgagaccagcctggccaacatggtgaaaccccatctct

SEQ ID NO: 69550 - DNA, 531 bp, Homo sapiens
tgggatcgtcgggtcaggccttgggccaacgtaggcactctcgcagttcctccgccttcaggaaggtctttttggcaggggccctacgggtgcgcgcttcggtcctggaggccttatccaagcctcctctccatcagcgccacccgtctggggtccgaaaggagggagctttccctctgtcccccagcctttggactgtcaccaaacaagccattcgttcaccaaatacttattaagcgcctaccaggcactatcctcaattgtcctgtgatatttacaatctagaaggcaggagagagaactaagaacagagagcatgttctgagatgtctgctgtgtttgcagaaagaggcttctccccaggaccaggattccacgaaggcagcccttttctagatggagaaaatagaacctgaaggcagccgtttccctaaactgctctcgctcatgtctgtcagagaaaggaaatgaagcagtgaaagcatcctcccaaaagggacttttaaatccttctacctgggctgaactaca

SEQ ID NO: 69551 - DNA, 584 bp, Homo sapiens
attttctagctgactgattccagaacacacaagtacatggtaggaaaaaaaaggccagctacacactcatggcccatttcgatataacatgtaaatgatgttacgattcctacaggaaaaacaggaagggcaattgttgaagagctgtcctttgtccttgccacatacatctcaacaacctctctgctcatgacactagatttgatgacttatgagactagaaacttagtctcatcagtttcataaaaattaggcattgaaggaataaagcttcagtgcaaacagatggaatattgactacagaaagaatcacaggtgaccttgaagttggttgagttgaagttacatttaagaaaatttataagaaagattgggccgggtgagctagactagaagagctatcttggccaggaccctgcagaaaaagaggtggaagtgagatagaggaataaagggaattagaataaatcagcctccagagatagagggtaacaggaggaacagttgtttcagtgagaggcttccaatgagaagatgcagatcttgggagagcctgaagttcaggccagttgctgacagagctc

SEQ ID NO: 69552 - DNA, 394 bp, Homo sapiens
  misc_feature (3)..(3): n is a, c, g, or t
atntatttatttatttttggagaccagagtcctcagcctgttgcccccggcctagagtgccagtggagtttgcagtgagcccaagattgtgccattgcactccagccctgggtgacaagagtgaaactctgtctcacaaaaaaaagaaaaagaaaaaaaaagttccaaaaggaaagtggctgatttaggataaaaagccagataattttaatattatatccgttgtgatcataagaaagtacaggtacgaaaagagaaaaaagtacaccaactataacagtggctgtggtgggtggtggtagatcagatgactttctacccatttaccagacttcttgcattatggttatattacttccatccctagagaaaacattcagattgttatttttta

SEQ ID NO: 69553 - DNA, 452 bp, Homo sapiens
aggctttgctctcctgcattccttgtagtcagcagggaaggaccccttgttatgatgtgagttactctcaacatttcaggcttttgaagattaattcctgatctgagggaagattctggcagaactgggatatctctagaatgcactgataagggccttgtcagtttctggggtgggcaggtccttcttatagacggttttgtgactaagatacctgatcagtaggctttttttcctggctgtaactagtgatgggttgcaggtgggtgcgtgtggggatggaacatcttagagttgtctacaaagttaggcatcagagagcatgggtatcatggagagaactttttgattgagatttggggccaatttaagtcagttctctaatattttcttgcatttgagttataagctgttcctataagtaagtgataagggagtagtgggaaaatgca

SEQ ID NO: 69554 - DNA, 416 bp, Homo sapiens
tgaggtgggaggatcacttgagatcagaagattgaggctgcagtgagccatgatcgcaccactgcaccccagactgggtgacacagcaagaccctgtctcaaaaactaaaaaaaaaattttttaagtgacaaaagcaagttgaagaataaaatgtctaagatgaggctataaaaaatcattcaaaatttggaagcaagagtaagacgggaagaataatgactacccctacttaagatctccatgtcctgctcctcagaacctgtgaatatgttatgttacatagctgggggaattaaggttgcaaatcagtttaccttgaaataggggagttaccttgaattatccaggtgtgcctggtgtaatcccaaggatccttataagagaaaaggtgatgcgaagatggaggcagagagat

SEQ ID NO: 69555 - DNA, 453 bp, Homo sapiens
ccatctcaaaaaaaaaaaaaaaggaacagccagcgatatacaaaacaacatggaagaatctcatcaacattacgttaagtgaaaaaagccaaacaaaaaagtatattccatttgtatgacattctaggataggctaaataacatacaggacaattcccaacaagcagtaatcatttgggccacaatgtcagtagtgctgaggttgagaaacctcaactaaactaatttatggtggaaaaaactagaatagtggttgttgtctccgtgaaagcagagattgcctgtgaatgggcatgaaggatgtttttcaggtgatggtaatgtctcatatttcaatataaattttcattacacaggtgtatgcatctgtcaaaacttagcaaatgtatatttaagatttttgcatttatttgtaaagttcatattaaaagaaaagaatgggtacaataaaaa

SEQ ID NO: 69556 - DNA, 405 bp, Homo sapiens
ggactgagtaagggtaaagaagggactagggagaagtggatagataccaaaactgtttaggatatagaattggtaatacaattattattattattttcttttaaataaaaaataaaaccccaataacttttgttctaattcataagacttaatagcagagttatattattttttcatcatgttattcattcatacaataacacataattgtgtgttttttgcatgtcactagcttagttgtgaaataattcctacttcttcccctcatagaatgaaagagattcatgagtaggtaataatagcatattcttataattgaaatgatagaattattatgtgagtgcttaacctagcttaattatgcagagaaggcttgctggaggaggtggcaccagaaatgtgtat

SEQ ID NO: 69557 - DNA, 795 bp, Homo sapiens
tctggatctcctgtatatcattaaaaacaaaagctctacaaaatactggatattacagagtgactgagaaacaatttaaccacacggtcacttttcatgtgccatggcgcaggcactccgcagcattgcgattactatgaattagacaaaatccctgctgtaatggaacttacaatcaagggagtgaaagagtaaacataaataaatctaagcgaattttaggtagtgataaatacaatgaagagatcagcaccatacccatgattgtcatagctctatcagtttgctagggctgccataacaaattaccatagactgtgtgacttaaaccacagaaattgattttctcggttccggaggccagaggtcccagataaaggtgtcagcaggtcggctgcttctggggccttcctcaatatgtaggcgccactttttctccctgtgccctcacctggtcacccctctgtgcgcgagcatcccactgtctctctgggtgtccaaacttcctcttcttaggaggacacaagtcagattggattagggcccaccccaatggcctcattttaacttaatcacctcccttttgtttgggctttttaacttaatcacctctttaaagaccttatctccaactaaggtttcattctgaggtatactggaggttaagactttaaaacacgaatttggaggggacgtaattcagcccataacaataacaataatgacatcttacaacttactgccaccaccaagcttgcctggccaccattccctcttgcctgcaccactgcaata

SEQ ID NO: 69558 - DNA, 949 bp, Homo sapiens
gagttggtgaagagatcaggaagagatttcttcgagactaaggatggatgacccttagcaacagtgaccgtctcctcccggcatagcaagatggcctgccctcaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccggatctttgtgacgtggaaggacagggaggggacaagacgagatacgaggactgggaaatggggagaacaaatcacaaagaacgatagaaatatctgacatacaacggaacacacggggaaataaacgggataaaacaaaaggaagcttaaaaagacaaagagcgaattaaccccacacactgacaccgaaagaggcaggcagcctaaaaacaaaacagagacataacaaacccataaccatagaaacatatagaaggaaagcacaaaagaaaacaagaacctggg

SEQ ID NO: 69559 - DNA, 1394 bp, Homo sapiens
gagttggtgaagagatcaggaagagatttcttcgagactaaggatggatgacccttagcaacagtgaccgtctcctcccggcatagcaagatggcctgccctcaggtccctgcctctggcgtgctgtccagtaattcttcagttctgtctttgcagaggattgggaaatttatttgtgttctgaaaccggcggagagcttttaaatggtctcttctggcctgagagcaacttttgctctgcatctgtggtggggaagttttaatgtgcgtctcatgctcgagttcaataaataaaacctttgattctcagtgtcctcccttcttgctgatgacgctaaggatgagatgattcagggcatgggacttcacggctgcctcagatttagagtttgcaaggttttgaaataaggagagcctgttctctagctatttgctgtgccccccacccccccgaaattgctctgtcgagttgtgatttttcagaaaccgtatctatcttacctctgcactacctgggtgtttgttcactgcacctgcatttccgtcttaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccggatctttgtgacgtggaaggacagggaggggacaagacgagatacgaggactgggaaatggggagaacaaatcacaaagaacgatagaaatatctgacatacaacggaacacacggggaaataaacgggataaaacaaaaggaagcttaaaaagacaaagagcgaattaaccccacacactgacaccgaaagaggcaggcagcctaaaaacaaaacagagacataacaaacccataaccatagaaacatatagaaggaaagcacaaaagaaaacaagaacctggg

SEQ ID NO: 69560 - DNA, 794 bp, Homo sapiens
ttttttcctctccttttaactaaccagtcaaattaatgcttaacttctcattttggttagggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccggatctttgtgacgtggaaggacagggaggggacaagacgagatacgaggactgggaaatggggagaacaaatcacaaagaacgatagaaatatctgacatacaacggaacacacggggaaataaacgggataaaacaaaaggaagcttaaaaagacaaagagcgaattaaccccacacactgacaccgaaagaggcaggcagcctaaaaacaaaacagagacataacaaacccataaccatagaaacatatagaaggaaagcacaaaagaaaacaagaacctggg

SEQ ID NO: 69561 - DNA, 990 bp, Homo sapiens
gagttggtgaagagatcaggaagagatttcttcgagactaaggatggatgacccttagcaacagtgaccgtctcctcccggcatagcaagatggcctgccctcaggtccctgcctctggcgtgctgtccagtaattcttcagttctgtctttgcagaggattgggaaatttatttgtgttctgaaaccggcggagagcttttaaatggtctcttctggcctgagagcaacttttgctctgcatctgtggtggggaagttttaatgtgcgtctcatgctcgagttcaataaataaaacctttgattctcagtgtcctcccttcttgctgatgacgctaaggatgagatgattcagggcatgggacttcacggctgcctcagatttagagtttgcaaggttttgaaataaggagagcctgttctctagctatttgctgtgccccccacccccccgaaattgctctgtcgagttgtgatttttcagaaaccgtatctatcttacctctgcactacctgggtgtttgttcactgcacctgcatttccgtcttaggtacaggaagaaggaatggaatcggaaggaagaaaattcattccagagacaaaatagctcccctcctctgttgtagctgttcctctggcaatacaaactttctgctttcagtgagtattatcttgggcatatttagagtagagcatcgttgtagtttttgattttaggcatgtgctaggattttgggatgtaggtgtgttttcatttgtatttttctacttccatgagggggtcctaatgttgatgaagtttttccgcttgttcccttttaaaataatttaaatatgcaaaggcaagtttgtttttcatactcccattagagtgagctaggtggtggcgtggcatgatctttcctttatatttctagtttgtaaggtctggctcctcacccttcccaaatgagtttctcaatacaaccaaagaggttgtcttaagtttta

SEQ ID NO: 69562 - DNA, 1105 bp, Homo sapiens
aatatattcttcattatttagttttgtgattgtggttagttttcatttttcttaagtatctgctagtagcatctgtaattaagtgaagtgacctgttaaccattttcctctttctcctcctttcctcctccttgaaacatatcagagcatgtttgaaattctttggcttttatggtatgcatttgctgatatgcattgaccagttaccttactcacagatacttcttaggcacttgattgtgccagggccttggctagatgataagaatacagtagtgaacttaacagtttccctgccctggtgaagcgtatggtcttgtaggtgagatagatatcagataatcatgtgaataaatgtacaattccagctgtgatacatgctgaggaggaggtttttggtgatccaagagctgatcatgcagagataggactgagaaaggagggtgggacgttgtcacagctgataatgcagagataggactgagaaaggagggtgggacatcaggaaggtcagagaattccttatgaaagtgatgcttgagtcaaaatatgatggatgaagagagtttaaatagattacatagaatttttaataatgtcgattggttatatactgggcactgatagctgatttttctttggggaaaggtatgtcagcctagtcattcagattcctttatttttttaaatgttttttcattttttgctttgcattgcattcatttgctgaagagctggcttgtactttggcaggtgtcatacttggttattctccttaggatattggcccaacaatctgggagttgtgaaaggcgcttcgcttttcagacctgggcgtctgtatcatgactatcataaatttaggattaagacacctagcctcctaccaggatgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggag

SEQ ID NO: 69563 - DNA, 793 bp, Homo sapiens
cctacatcctgaacctggagagtaccccacctcagaggcctgggcacatcggaccccagcgtggctccctgaagcccatgagattgggctgcccaagtgtggagaagccaggggagcccagggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccagcacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtgcgtgccggccgcggggggcggggcctccccggtggcgggacctggagttcgggtgcgccccgcccccacgcagaggtagcgggctggaggacctgcctgggcgcttggggcggggccttagaagggggcggggccga

SEQ ID NO: 69564 - DNA, 341 bp, Homo sapiens
cctgtatgaatgataatctagcaaaacaaaaaaatagagcattctcatagttgtattaaagttattgggtgatactcctattatttggtgataaaaattaaataccttttatggctagagtgaatattcccaccaatgttaccaatctgatacacaaaaataaatagtagggtttaagtaataagggaaagatcaacttttccttaagataccatttaatgtacataattattaaaacctataattttcaaatcaatgaaattgaggaaaactagaaattttggatagttttttagcgcatgctacttaaattttacgtttttttccttctaggtgctaaa

SEQ ID NO: 69565 - DNA, 6386 bp, Homo sapiens
  misc_feature (2059)..(2059): n is a, c, g, or t
  misc_feature (2443)..(2443): n is a, c, g, or t
  misc_feature (3518)..(3518): n is a, c, g, or t
  misc_feature (5196)..(5196): n is a, c, g, or t
  misc_feature (5235)..(5235): n is a, c, g, or t
  misc_feature (5237)..(5237): n is a, c, g, or t
  misc_feature (6208)..(6208): n is a, c, g, or t
gttttaccttacggtcgctgggaatctaagcaacaaagactagaagcctccgatatgccattatcaacacacaagagacaaacagcccgaggaagcactcaatgatgagagcagtagacctgccctggcagatgagagaggagaaactctccacaatgaaggaaaagcactgacagtatttgatagctttagtcaaactgtgcttgagtttggcttagatttatgccagtggaacctgtccttaccaaattcagagatgacccaagattctactctgtggtatgagggaaagacctctcgatatttatctcacaccaacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgcttccgattggcgttgtcccaaggaagcctgcgcggattgatcggcggcaggcctccaatagagcctgctaggcggattggctgctacgcggctgggccctgtttccggtacctaggcgggcagccatggtgaccggcgagcggcatgcgacgccgcctctgtggcctgtggaggcccgcttggcggcgctgcttcccgacctactggtctttcggaagcctcggggatgggaacccgagctcgccacggcccagggcgtcctcctaggcgtccatgtgacgggtgagggcgacggccggcacttgcacttaagtctcctggcctgcgggagaggcggccgttgggtctaagcccctggaggcctcgacggttacaggcctagcctcccgcgagctaaggcacagtttaacttcgtgctgcggcttccttaggaaactttgagtatcttcgttttagcgtgggaggacatcttttgggatgaaccggctcagtccttgagctcaccccaaagatgatgaaattgaaactcagaggaaaggatttttacaggaccacgccccgggctttgaacccgtttttcccaaccccgagcattttctattaagcgttctgtttcaattattttattcgttcagttaattcgttcttggcgtcataagtatatgcccgccgttgttctggccgtagctatctagcagccactccgcgagtcgttcatttaacaaatacttactctgtgtcagggatatgaagatgggtaataccaggtgcctgtcctcactgtgtgagtggttctctagccagacatgaggagggatcctattgtttcccatagctaggcagcctaagagagtaggggaaagagctggctccagatgaaaagggcaccatctccagctcttggaagcagagagggtggtcctttggattcccagtggcagcagcaaccaacctggcccttagtagtttctaagttacaccatgttaatggataaaggaattactcagcttgaagggatctgtttcctttacactggcctgatgtgtggggagaaaggggccaaaaagtttaggatttggagttaacatcgtaatttctgctttgttggtcagggtttacagcattaatggacaggttcaccctgacctacaagtcggaacgtgacatggacaaactggcccatatcttcagttattacattagtgacatcgtggagcgtgagtgatcattgtagggtaacaaggtgtggtgctgggctcctgggggtttataaaagaagggggccagaagtactttaaaacaggtaccaaagggtcattcctttagcatcattcatctttggtttcttcaagttgccactgaaaagctagacctttgcctattatctgctaatctacccagtctcacattctattgactcattgttcaaagggggggcaggaggagctaatttcctttgcacatttgtattttatttcaaaataaagtattctcttctaacaataacgtatctcaagtgtgtattcagacaaaatttataaaacatctttttattattatattttgatcctgtgaggaangaataggtgttttcttattttctgccatgtattaagcttttagatatttgccagatatccagtatctggaaaaaactcatttatgtagtacccatgttttgagtacctaccctgtgacatggactgtaataggtgcaggcagggcaagaacccactcttgaactttttagttaggcctacccaacagaaattactctgaccttataccttttagtacttacgtaacattctcatcctttactgacagtgccctgtatgcttccgtccatcattctgagattcaccagaataattactttgaggcatctccgttaagaatttgattatttgacttacctcttatccttaaggaacacatggaaggtcgtttgctttttcttatangtttggatgaaggggaagataaacattctatatcgtgtatgtactctaataccagcaacttctgggtactagaactacaggggaaagtaagacagagtaccctcgtggagtttccattttagtgggacagacaataaacacaataattgtagcttatatattctatcaaggaaataaacatagtatagtggtaaaaaaaaaacacaaaaaataattttagggtaggggagtatatgagacagggtggtcataggctcctctgaggaggtattatttaagctgacacttgaaggatgaggggaacagcttgtgaagaactaggggtaaagcatttcagacagaataccaagtgcaaaggtcctgagacaggagaaagctcggcatgctctaggagctaaaagaaggccagtgcaggccaaaacgtagctcgcagggtgaagagtggtttgaggcaaggttgggggatggtagctatgagaccaccacgctctgtagtccatagtgaagagttggaattatatatttctgtataaaggaaaactgtggaaaggtctagcaggggagtaatatgatctgattaacactttaaagctgattttggctaccttgtggagattgaatgctggtggaaagtgaatttaagaatagaagctggaagaggcaattgtcctggaaagatgttggagatttggtctagagcagtggttctcaacctcagctgtggttgcctgaggagctttttaattgttttttcttttttcttttttttttttgtaagagactggggtctcagtatgttgccaagtttgtcttgaactctagagcttaaaagattcttctgcctcaacctctcaaatagctaggactgcaggtaccataccaccttgtctaacaaaaaatcttaatgcctaagcttcaccccaggccatttaaatcggactttcttaaggttggcccaggaataagaccttttaaagtttcataggcaattccaatgtgcggtcaagactgaagattgttggtgtagaggtatggcaggggagctgtgtggggtagattaacctgaaatatattntgcaggttcaacagacaggagttgctaatacgttgaatttcagtgggaagtggtgagaaaaaggactcagttttttggctttcataaatgaattgatcgtgtcatttaccaagacaggaaagactgaacattgagaaagaaaatcaagagttctgttttgagtatgttgagtttgagatgccaataagtcattcaagtggagaatgactccattcaagtggagaatccagctatgattgagcctggagctcagagaagagatccctgttagagatgaaaatgtgagttgatggcataaagtgggacttaaagttaagaaccgattgagttcatgttgggagagcataaataaagagaaagagcctttggctgaggcttgaggaactccaggggaggattatgataagggagaaagaacctgaaaaagagactacaaacagccagtgaggtaggatattgtggtgttcctgaagccaaaggagaggtagtgtctctagaagaaagctgcagctagctgggttgaaaatgacagctgtcaagtacagtgaggtcagagaggtattgaatttagcaagattaatgctgttgatgaccttgataatttgaagtggtggaggtagaagtcagagtggagtaagctgagaaaaagaatgacagagaaaacatttaagaggaagagtaaatgggagatgaggaaaatatatatagccaacttttttgagatttgggggttttgtttgttgtgaatgtagcaggaaaaaaaatggagctaataggcagaagataaggtagaaccaagaatatgtgggttatttttgtgtgttttggttttgttttttaagctattgatgagaatatttcagtagagagattaggaacggtgtgaagttcttgagaaggtaaaaggggataagattcctatcacaaatggggtggctttgaagagagcaggaattcttccattttagaaacgatgtatgtaggtgcagatagatttggggagaaaatgaaaagaaggaagaaggagcctgagtcttggagtgagcaaatggacaagaatgatgtcaggataaactcagtaggccattcttttgaccatatatgattctgccctgatctggtttatatctgattttgactcattttcctctctcttccttacttgatttcagatgttctctgttttggaggggatatcctaaatatcacaggtatttttttagtttttctgaatacttaaaagactgagtgaggaggactatatttaggtggaattcagcatattggtttattcagcattgtttgattaataggtactggaccctggggatacaaagatgaggaagacatagtctgtgcctcaaaggatcccccagtctaatggaaaagctttgcccaaattaaactctcacatgctttgcatttttgtttagattgaaggacagcaaaataagtgccaataaagcgttcttgagaaaactaatgagaaatttggtcattaatagcagaagctaagcatgagatggggaggagttaagcatgtcctatctggagaactcaggatcactaacagctgtatgccccggagttggcctgtcttcttatttaaacataataaaaccagccatcaaattagatatgaacttgaacccacattttatgaatcttttgctagtanctctcctcctctgttagtatactggtggaaggaagattncnaaaaatatccttaggatcatttaaacttctacctagttacgtttttactgaatgattttgaggatctgaagcagtattttaacctagcataatgtatacagccaagaaaccttgcctgataacttacttgatatccacactgggtcaagttgatcttctgcattactgggactttgccctggaccaagtaagtctagatatttggtccccatcagcctatcctgtgtgtctgcagggaacatgctcctggcactctggagagtagaacaaaatcaactgagtgacatcattaccttggtggcaaaatgcagtctggagatacaggagaaatttgggatctatcataccagggaaggccaggacctgcagttaaagataggtagtacctcctaaaagagtgatccagttgggcaagggggaacccactataaaaacctcaaaagataaatgataaactgggaaaaaatgtttgcaattcatatagacaaagggtgaattgctctactagggaaagagcacttagaaatcaagaaaacaatagtactcttaagagaaaaattggacaaaggacatgagtaaattgtatatagacaaggaaatgcatgtcttttaacacgtaaaaagatgatcaacattcataataagaaaaatgccaattggaagtacactgactacctgtcttacctatagataggcaaaacttcagatgctgacaatgtactctttggtgagtctgaggaatgagctttttcttactgtgagtgaacaacggtataaggtgatttggcaatctttatttatttttattgtctattgtattttttatgtcaacaaaaactaaaccatataaaaatatatattaaaaagtcttgttttcacttatataccatctatactatttactcttacaagtgcatttattccttaacctagcaatccttctggacatctataggtatacgttcacacanctgaaatgttgcatgtgcaaggttattgattgtaatatggtttgtaattttaaaacattgaaaactatttataggagactggttaagtaaataatatgtatacttaataagattacctgcaacttaaaaaaaataagatgtcttgatatggcagtatctccaagatacagttaagtga

SEQ ID NO: 69566 - DNA, 292 bp, Homo sapiens
ataggtaggctattagtagttaagtttttggggagtcaagttatactcggattttcaactgcacagggagtcggtgcctctcagccatgcattgcttgagtcaactgcatatatctggaatataatcattttaatgtgtaatcaatataaaaaagttttgagatattctacacttcttaaattccagtgtgtactttatacttagagcattagccatatttcaagtggtcaacagccacatgtggctagtggctactatactgaacagggtggtagcataaactacgatatt

SEQ ID NO: 69567 - DNA, 939 bp, Homo sapiens
gttagatggtagaaatggtaacaaatatggcaagagttcctattatctagaaacatggcagtatagtggcacctcaatctcaaataatatggcctgctgcaggagctaaacataaggatttgtggacactattcatggctcttaatgagatcaaaatttggaaaagaataaaaaagcatctagaaagacactctacaaacttgtctttggatattgcaaaattaaaagaacaaatatttaaagcatcccaggcacacctgaccttaatgcaaggaactggagtgcttgaaggagctgcagacaaattagcagctagtaacccattaaaatggataaaaacactggaagctctgtaatttcaatgataattgtgtttttaatctgtgttttttgtctttatatagtctgcagatatggatcccaattcctgtgagaagtagctcaccatgataaggtcacctttgcttttatcatcttgcaaaaacaaaaggggggaacatgttgcgaacaggtccctaaatctggccataaactggccccaaaactggccataaacaaaacctctgcagcactgtgacatgttcatgatggccatgatgcccacgctgaaggttgttggtttattggaacgagggcaaggaacacctggcccacccatggcgggcagaaaactgcttaaacacattcctaaaccacatacaatagcatgagtgttctatgccttaaggacatgttcctgctgcagaaaactagccaaagcccatccatttgtttcagcccatccttttgtttctcctaaggaatacttttagttaatccatactctatagaaaaaagccttcttactagcttgttgtcaataaatatttgggtaaatctctgtttgtggcttccagctccaaaagctgtcaggccactgatttcccactccacactata

SEQ ID NO: 69568 - DNA, 688 bp, Homo sapiens
gtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagcttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccaggtgagcccca

SEQ ID NO: 69569 - DNA, 790 bp, Homo sapiens
gtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccaggtgagcccca

SEQ ID NO: 69570 - DNA, 2254 bp, Homo sapiens
  misc_feature (1)..(1): n is a, c, g, or t
ngcttgaacccgggaggcagaggttgcagtgagctgagatcacaccactgcactccagcctgggcaacagaatgagactctgtctcaaaaaaaaaagaaaaagaaaagaaaatgagaaacgaaaccaagaccaaatggacctgcagtccttttataacctaatttcagaagttacattctatcactatctcactgtattctttttattagaaatgagtcactaagtctgggtcacacttaagtggaaggtaattaattaaacttcacctcttaaggggagctgtgtcaaagaatttggagacatatctacatagactacatccatctacatggactacaacaatgtcttttttcaaatgttaccttcccaatagagtttaccctgactactcatttaaagttgtaagctccatttgtcccccctgcaccttagcactcccatttcatcttaccatcctctactttttattttttctatagcacctagtttccaacatattgccataaaatttacttattttattatacttactgtttatggtctatctcctgtctgttagaatgtaagctcaacaaggacaaagatgtatgttttgtgcactggtctagcccaagtgcctagaacagtgcctccacacatagtaggcactctataagtgtttgttgaatagaagaagaaatcatatcttcccactcttttttattttcctcctcttatgaataggccagcaaataatcacctattggtagccttagacataggcagccttacatgtaaatagatgagtagcctatattcccattctaccacctgccttatttgtttgacatttatgttttctgaaaggcagtcccaacttcgggatgaagtgtatataaaccttgaatcttttattattgagaaatcccagaacctctctttttttagagccagttaagagactaacacctcaaaagtcaaaagaataagtacctaacaaaatcctggaaagaaaattagtcttagagtcacaagggctccacttccacagttagaagggctacccttttaccatgtacctgttgttcaatatgtagagaaagccataggattcagggtggtttttttttagtgtccatgtgggcatcgtaaaaaaggataagtctagatgcatgagaatatgctccctcctattatgtgtgtcagttctccgacctagaaaaacttgcagttaattcatcctttcggtattcggtcaggtgcatgcgggctgaatgaggttctgtgagcatataaggtatgataatattgccatcaaagagcttatagtgcttagtgaatgataataagggccatagtagtggagtgattagaaaaagctttctataaatggcaggacgtgaactgggctttgatttaggctttgattgaaaactatgtggaagacattttaggtgggaagcacttgggcaaaggatggaaaataagaataagaatggatgaggattagtagaaaataaagttagcaagataataacttgaggctaaattgtgggggccttaaatgttgggctggcagattagtgttttattctgaaggtggttttcagttttttttgttttttttttttttttttttttgcctgtaacacatttatttctccatttagttcaattgttaacgactgtcattatgtgctgtgattctcaagtggggacacatctcctaggagggagatggggcacattctccttgcacttattaattactgttgcagatagtgggaagccattgaaagttttgactggagaattgacatatgaaggtgatctttaggaatattaggctcttggtcatatgcttatgtgatttgaagaatagtgatgccattgatagactaggaagatcatgggtggggtcggtttaaccgtgggcatataaaagaattgttttccttactgaaaatatgaatgtaccagtatttgagctctggaatgaaaatctccagggaggaaggtatggctgtgcatgtttctcaactatattttgttttttctgaatttcaccttctctttggggttttctcactgtgaatcctgtagtaaccaggggttaccacttctttttttttttttttttctcaagaagagctaaaaagacctctttctttattttccttttgcaaaggcttataagggcttatgttttcaaaaggaaatttattaaaaattttaaagtaattttttaaaaaaattgttaaaattttgagagag

SEQ ID NO: 69571 - DNA, 526 bp, Homo sapiens
cttagcctccccacgttgcagagaagtcagctgctagtcttcacattaactgcagactaaactgcagagtacagcttggctttccaatcacactccaccctacttccaccagcaaatgcagaaaaatagaactgacccccagggagactgggaaaggctctgtattactttccggcttaataattctctctacccccatcatttcaattcatccagcagaaaggcactcagatcaacatctctcatctccaggggaaagagtctcagaaattacaaagtaccctaaaccaatttcctatactacttttgtatagaaaaaaaaaaaattatcctggacagaggagtgcagactgggttcctgcccagttataggtaatgcaatattcctaatggaagccacggaggcagaacacacacacatacaccaagaatcctcacatttttcctgtctcatctgaatgcctaaagtgtacacttttgttgatagtcagcataagaggaataaatggcctttgtagaaatgttt

SEQ ID NO: 69572 - DNA, 5278 bp, Homo sapiens
ccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtca

SEQ ID NO: 69573 - DNA, 5711 bp, Homo sapiens
  misc_feature (5284)..(5284): n is a, c, g, or t
ccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaaaaaanaaaacaaaccaaaaaaagaaaaaaaaaaaaacaagaaaaaaagaacaacaaaaacacacaacaaccccctatttatcaaaaaaagaaaaacacaaagcaaaaaaagagtgtggtgtggcggggcgcggcgcgcgcgccccgggggagagggttgtagtagccacaacccgtgggaggcggcgcggcgccgccacagagagggtagaaaacaaagagcgagcaactgggcccaacagaagaagacgcggcgtggcgacaacagaaacaaggagggtgggagaccactcacccaaaagaaaaagacacgcgccgggcggggaaccaccgcggcttggtgaaaacaccaaccgccaggggcgggactcatgaagacccaccgggggggatcccacaagggggggcccccagagggcgctatataaaagcg

SEQ ID NO: 69574 - DNA, 2137 bp, Homo sapiens
gaggatcccggtcatttgctacactttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtca

SEQ ID NO: 69575 - DNA, 1515 bp, Homo sapiens
ggcggaatcagcggggaaagaagaccctgttgagcttaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtca

SEQ ID NO: 69576 - DNA, 715 bp, Homo sapiens
tttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggtgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtca

SEQ ID NO: 69577 - DNA, 540 bp, Homo sapiens
ctacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaa

SEQ ID NO: 69578 - DNA, 832 bp, Homo sapiens
ctacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaaaaaaaaaaaaaaaaaaaaaaaaaactgtgggttgggccggcagtggcgaccacaaaaaaaaagttttccaagacccatcgcggtggggcgccggggccccagtgagtaatgtgaacctggccaaagggtgtgcaagagaacccggggtcctgacacgggcccggtttccccacacaaaaaaaagcgccgggcgcgccggcgctctgcaacaaatccgaggggtcgaggcatcactggcctacacagggccaccagccatgagcccgccgcgtcgcggcggagagaaagacgt

SEQ ID NO: 69579 - DNA, 518 bp, Homo sapiens
ctaggcctctgtgattgttgaggagggggctgtcactgggaaagtttccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaa

SEQ ID NO: 69580 - DNA, 466 bp, Homo sapiens
ctaggcctctgtgattgttgaggagggggctgtcactgggaaagtttccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaa

SEQ ID NO: 69581 - DNA, 384 bp, Homo sapiens
ctaggcctctgtgattgttgaggagggggctgtcactgggaaagtttccacgatggcccggtccctggtgtgccttggtgtcatcatcttgctgtctgccttctccggacctggtgtcaggggtggtcctatgcccaagctggctgaccggaagctgtgtgcggaccaggagtgcagccgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaa

SEQ ID NO: 69582 - DNA, 493 bp, Homo sapiens
ggcagggaaggggatgaactagaggatgggaaagtagtaagactccaagcagaggccagaaaggggcagaacagcaagagacaggaaggtcactgagtgccacatcaaaacatgcaggtcacatgcaagaactgtgtaaacacaccacgcccttaacaagcactgctgcgcggacagggcctgctgttatctagccccaagtcatctgctttatcttggacctcagtcttcttggtcactaaagactgaatcctctgtccaggagtagggattcaaagagctctgtcctttcatccgtgctgtcacatgaagaaaaaagaaggaaaaaggacctctgtccaacactgttctcaacctttctgtcctagtgttaaaaaatacgtaacatgcagggtgcagtggcttgggaggccgaggcgggcggatcacctgaggtcaggagtttgagaccagcctggccaacatggcaaaaccctgtctctactaaaaatac

SEQ ID NO: 69583 - DNA, 741 bp, Homo sapiens
gagtgtaaattcaaatcctgagtctgtaactcccgactgtgccgtcattaacattttaatctttctaaaaatctatgaagtaagtattatgaaagttacttcgcaggattgttcttagaattaaatgagattatggagacaaagcacctgtcaccctgtgtttgacatgtggtaagcattcagtgcataacttgatagctagccagattttgttcctacctataatgtgttaagcttttattacatggaaaataaactatgctgacttctcctttctcaataacactagataactaaagcagtaatagtacagattattaataattatttgttataatataatgggaatcatgtctatgtcactggtctccaaagaagggcttaccccacaatagtttatacaaacaggtgcattggtatgtggggaaaaacatgagaacttccatttatttttttatcttttaaaatttaaaatttttgaatctattgaaattatagtatatctgtacatgtttcatttataaataaataaatatacacacatcgtgggtgtatgtataaacttttttgaagactcatgaacaaaatgtttgagccaataggtatactcagtgagcattcataaagtagatgtcacagtgtttttattgggtgtctgctacatgaacaggactaggtattaaatctttaaaggcaaatcagatatggatatggatttttactttaaaaagcttaaagtct

SEQ ID NO: 69584 - DNA, 508 bp, Homo sapiens
  misc_feature (216)..(216): n is a, c, g, or t
  misc_feature (284)..(284): n is a, c, g, or t
  misc_feature (292)..(293): n is a, c, g, or t
  misc_feature (312)..(312): n is a, c, g, or t
  misc_feature (352)..(352): n is a, c, g, or t
  misc_feature (355)..(355): n is a, c, g, or t
  misc_feature (483)..(483): n is a, c, g, or t
cacccgcctcggcctcccagtgttctgggattacaggtgtgagccaccaccccagcctcattacaaatttaaaagtgaggtaatgaaagctaactagttcccgcaaggtcacacaagtagagaccgagttaaaaagaaaattattttattttttccctcctgcacgacatgactctgttttgattctcaaactcatgtcagttactgggcctgccnggtgtggtgactcatacctgtcatcccaaagctttgggaggccgaggcgggaggattgcttgcagccnggagttcnngaccagcctgggcaacacngtgagacccccatctctaccaaaacaaattgtttgaattngcngggtgttgtggcatgttcctgtagtcctagcaacctttccacttgggaggctgaggcagaaggactgctggagtccaggagttggaggtcacagtgagctatgatcgcaccactgcactccagcctgnggaacagagtaagactctgtctctc

SEQ ID NO: 69585 - DNA, 223 bp, Homo sapiens
ggaagcagaacacatacacgaggaccagtacttgatgaggacaagagagatgggaaacaggctgtggaattcctttcggcaccctgaatgttaacccctgctcaggaaagggtgcatctgtcttcatcatgcctctctctcctcccctcctccagccacctcccaaaggcagagctgccgcaacctgcctggcccatgtggtggcaagtcacccagtcaggag

SEQ ID NO: 69586 - DNA, 337 bp, Homo sapiens
ggaaaatttacagcatgactacatatgttaggaaaaaaatatctaaaatcaattaactaagcttccatcttaggaaactaaaaaaagaagagcaaattaaatccaaagtaagaagaagaaaataaataataaaaattagagcagagagaaatgaaattatgaacaggaaatcaattttaaaaataaatgaaaccaaaagctggttctttgaatcaattaataaaattgataagcctctagccagactaagaaaaaagaggtagggcacaaattactaatatcataagtcaaagaggggacacccctacagatcccatggatattaaaaggataataa

SEQ ID NO: 69587 - DNA, 524 bp, Homo sapiens
gaaatatgacatctcttctgccttaaatctcaaatgtgtgcttcttaatggcagaatataacccagtaccatataggaagagagatcctcagaaatgtagttccagacttctctcctgaaatgcagagattttaggagtggggtgggggggtgataatgctaaattaacaacaaatagtccagcacagatgacctcccccaagtctcatctgtgagaagaaaggcttgcacagctctggtaacactgagctttacttactccacctctaggaagctgtcatattcacttgaaacatcttcctgcaggagcagtgcaacaaaacttagaacatttccattcaaccacatcttaaaaacccaccatttagaaagcaggcccaggtaatgtggggtagtggaaagaactccagttttgggggcagacatactgagtgctaatctcagctgtactccttattagccatgtgaacttaagcagttatttaatccttctgggaaaaagtgattataaaataatcagagct

SEQ ID NO: 69588 - DNA, 965 bp, Homo sapiens
agcggagcttgcattgagccgagattgcgccactgcagtccgcagtccggcctgggcgacagagcgagactccgtctcaaaaaaaaaaaaaaaaaaaaaaaatgttagatatcagttgacttctcactatttggctctcttatactatactcctcctacccctacttcctaaaaccacacattttttttctcctattgttccaatataatttctttttttgttgttaaatcagtttagtaatacagttactttgactatgtaaatgttgcgtgtgtcttcctgagcatattatatactgattactttgactttttaaatacaacttattttgtttcctggagctaataatggcctatgtccaagccttccaaagttttactggaagttctcagtgtttactggaattcctgagccatggtttactgggtatgtggcatatccagggcgggccctgggggaagtcaaccctactgcaaggaccattttattactggtagaatttacagttgttggatctaggtgataaaaggctcaccaactttttatcagttatatttcttagattttctgccaacagagcacccacttattctttgcccttggatgttctgcttccaccaacctgtccttgctaagactgtgagttcagctaagcaaggcaaggggtggtgctctgagagagtggtagtgtgttccaagaagatgggacaacctgagtggaaagccatggcagtgagagatagcatgttgtgttcttggaattacagatagtttggtataggtagagcgtagagtacagggcaggactagccgagatgaggctgtgtggtgggcaggagtcagatcaaggtgatctttttattacagactcatactcactagattctgtcgtgtaggccatggggaaactcatactgttaagtaacatggtctgctttgcttgtgaatgaatgacagagtaagc

SEQ ID NO: 69589 - DNA, 1711 bp, Homo sapiens
gagaatctaatgccactactgatctaacaagaggtggagctcaggcagtaatgctcactcacctgcctctcagctcaccaactgtgtggcccgattcctaacaggccacacacagcccagggctggggacccctgctttaactgatgcattgatttgataaagtattttacaagcctgataatgttataaccctgtttattcaggtcagatttatgccaactttgctgagaatatggagggtatagatgagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaattgtcg

SEQ ID NO: 69590 - DNA, 2366 bp, Homo sapiens
gtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaaa

SEQ ID NO: 69591 - DNA, 3689 bp, Homo sapiens
  misc_feature (993)..(993): n is a, c, g, or t
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacngcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaaa

SEQ ID NO: 69592 - DNA, 3481 bp, Homo sapiens
  misc_feature (993)..(993): n is a, c, g, or t
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacngcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaaa

SEQ ID NO: 69593 - DNA, 683 bp, Homo sapiens
ttaaaaaaaaacccttttaatttataactggaatttcaacatgaatgttaatgtagtttgggttcctgctctctctcgctctctttcttttttcctgagagagtgattttgtaccatcagactgttttgaagttcttagtcattttgtttctttattagtaaaatgggataatggtacagcatggatgtgagcattagaatactgtgatttgggaaaagaacccagtgctgtaacggaagtctaatagctgctcagtacatagtaaatgctatttcaaatttagattaaagaaaaaacatgttcacggtctatgcaggcagtgtagctctatatgaaaaggaacctattgattaaatacttagaaagtttcaaaaagcccccttttaaatcctaagatattggcattcatgtgatggatgtcttgaggcagataacacagttgaatctttttagtggaagaaacacagatcttttcacatgaagttgtacttgaaaaatattgccataattaaaatatacagtgtagttatcaggaaatgtacatttttttgtatcttgaaggagccttacagagttaataaaaaaaaaaaaaaagaaaagaaaaaaaaggaacagcctctaatggaaattagcatgtgattgaagttgtttttgttttgttgtcctctttccttctgtctga

SEQ ID NO: 69594 - DNA, 493 bp, Homo sapiens
gctttagttaattattaatgaagttaaagaccctttttctctcactttcatgttggaaatcaagtccaaatatcaagtttttatgaccttagaatattatgttcaagacatgtgggagttccttcagtttagaggttttgattacgtaggatttgatttaaccaattttgtcctcagttttttcttttgttgtaattgaaagttaatctattgcttgttagcatttttaccaaaggagcagagagtggcaaagaacttcaaggcaattggctatttgtaactaagtgggagcactatgatacatgaatagtatgacaaatgaagtcttggtcggatgcggtggctcatgcctgtcattctaacacttcgggaggctgaggtgggaagatcgcttgagcccaggaatgtgagaacagcctgtctctacagaaaattaataaattagccgggcatggtggcatgtgcctttagccctagctactcaggaggctaa

SEQ ID NO: 69595 - DNA, 3469 bp, Homo sapiens
ccagtctgcggaccgttcggagcaacgtggcggcccttgcccgccagcaatgcctaggagcagccaagcagggacccgtcggaaacccttcatccaccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69596 - DNA, 3375 bp, Homo sapiens
ttcgacgtgatcagacccaactcagacccggtcatacttggaccgaatgctgccaaatcccccacctctacccagatctgagcctacgcggggtgccgacccagctcgtggacggggatacggtgacctttgacccaaaagtcttggccgggaccagccggacactggccctcggccgggagctccgagtctcaggcggtcccggttgtcttcctgtcggtgccgcttccgcctgcccttcttgaaaacccacccccagctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69597 - DNA, 2778 bp, Homo sapiens
accccctccggatccggcctctccttcccaccgcctaccacctcctcccaacaggtcctggccagtctgcggaccgttcggagcaacgtggcggcccttgcccgccagcaatgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69598 - DNA, 3482 bp, Homo sapiens
gtgcgagggacaccgtctcggccccgggggtctcctgagaccctgtctccctgccctccatttagcagcgatcagtggacaatttctgtcttctccactccaagtccttgtcttggttcttttccatgcagcgctataggggacggcagacggttttcggggctggtgtgttggggggggtctcttcagcccctagcttcaacaccccctcaccacgttcttctcccctgttctacccttcagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69599 - DNA, 2613 bp, Homo sapiens
accccctccggatccggcctctccttcccaccgcctaccacctcctcccaacaggtcctggccagtctgcggaccgttcggagcaacgtggcggcccttgcccgccagcaatgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69600 - DNA, 3597 bp, Homo sapiens
atgggacccaggcaggactccgcagtggtgcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69601 - DNA, 3322 bp, Homo sapiens
  misc_feature (26)..(26): n is a, c, g, or t
gctgtccagaaaaggtcccgcgcagncggcgctcggtccagcctccacgcagtcctggcgatgcagggcccccccgcgcccgccccggtccccgggcccggctcccctcggggatccccgcgcggctcccccgggctcttcaggaagcttttggtgaatcagagcatccgcctgcagcggcgcttcacggtggcccatccgctgtgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69602 - DNA, 4611 bp, Homo sapiens
gtgcgagggacaccgtctcggccccgggggtctcctgagaccctgtctccctgccctccatttagcagcgatcagtggacaatttctgtcttctccactccaagtccttgtcttggttcttttccatgcagcgctataggggacggcagacggttttcggggctggtgtgttggggggggtctcttcagcccctagcttcaacaccccctcaccacgttcttctcccctgttctacccttcagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagtaggtagagggcggggcggggcgggggcggggccggcagagacaaggtgggcggaaagcgggctgcaaattgaggctggggctccggcgcctccaggtgggtttgaggggcggggcctggtggacttgggggcggggcgagatgggcggagcagccacgcctgaggctgctgtaccgcaggcagggacccgtcggaaacccttcatccagcaatcagctccctcctgcaggtaaagtacctgttccttccctcccccgctgaggacagctgggagcttcctttccatagtgacctccccagtccatgagccccttatactggggctaattgtagccccgcccctgcaaaaacaataacgccctcggggatggaccccaccacactcatattacagatgaggaggctgaggcccagagatctcatggtcacacaggcactcggggaacagatctggaacttgggtccaggagtcctgggtggcccccgtgggaacagtttcagggtccagatgaagagacgaagtcgcgagaggcgtggggtccctgagcgggggggttgggcaggcccctgactgcctcggctcccagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggtagcgatggggtttcaccgtattgctcagactggtctcgaactcctgacctcaagtgatctgcccacctcgacctcccaaagcactgggattacaggcgtgagccactgcgtccggccgacagggtctttactccgaacttactttggttcctgtagaaagggaaataggttgattctggggtttggcaaaattcaggtcctgaggccaggccccagcaggtgaaatcggcttctctgagcttcaccctggcccatccgcagaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggagggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgggccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctggggctgacagagcaagacactgtctc

SEQ ID NO: 69603 - DNA, 237 bp, Homo sapiens
gcgggtgtaggtcccacgtgaaactgctggagcccggcggagcttcggacgggaatttggggtcagaacaggtccaggtctcaaggcaacccccaactctgtacagtggaatccgctcgtccagggtcgtgacccgggtgaggcagtgcggatttcagggtccccgtgctcccagcccggcgaagtttcacccttccttcccttgctggcttcctctcccagttccctggacgccga

SEQ ID NO: 69604 - DNA, 757 bp, Homo sapiens
aaactgctaaatgtttagccattgaagttttctaacctaaatttccttgttggtaaaatgggtataatactttctctgcctacctttatagggttattttcaggattaaatgcttttaaggaagtgaaactagtaaaaactatcggagggaagtgttgttattttcttcttttgagaacaatatatctttaaacatttttagaagaaaaaaaggttttgaattccttgaagaaaaggtgcttccaaagcatatttattgatgctattattgtaaatccctctttaagcttcatgcatttaaaaattaatgacaactctcctcttcctttctggaaagcttttatgacttaactccaaattctatgtgtttaaaaaaactaaagtatcatgtcctccttaaagaataccattattattcataacctctgaaaccagcgagggtcataaagctactgactgcgaatgattaagtggccacaaataaaacactggtattaccacatgtaaattctttccctgcagtttatgcctccgcaaacagtgattcaactgcaggtgtctgtcaagagacagtagagttttgtccttctggaagcctcactgtatgtgaagtcaagaaacaatgcccctgccactgtctagctatagcctcaatcaaatcatttcacctctcttagcctctgcttcctcttttaactgacagggcattcagtggctgtgcgtctgggcctcactgctctccccagaaggcatttga

SEQ ID NO: 69605 - DNA, 329 bp, Homo sapiens
gtcacattagcagaatgaaagataaaaaattatatatcatatcaatagacacagcaaaagaatttgacaaaatgcaatatcattttgtgataaaatctctcaataaattatgtattaatgtaccacaacataataaaggccatatatgacaagcacacaggtaatatactcagtgatggaaagcagaaggctttttctttaagattaggaacaagacaaggatgcccacttccacaacttatagttagtatagtactggtagtcttggctagtgcaattaggagagtgattgctgggtcacacggttaatatgtgcttaactttataag

SEQ ID NO: 69606 - DNA, 176 bp, Homo sapiens
cgtgagccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcaaagg

SEQ ID NO: 69607 - DNA, 1554 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69608 - DNA, 1865 bp, Homo sapiens
  misc_feature (1572)..(1572): n is a, c, g, or t
  misc_feature (1580)..(1580): n is a, c, g, or t
  misc_feature (1588)..(1588): n is a, c, g, or t
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctcaaaaaaaaaaaaaaaaaanaaaaaaanaaaaaaanaaaaaaaaaaaaaaaaaaaaaaaggggggggggcccccaaaacccccgcggagggggagccccagacgatgcagcgacgctgccccacgacttgtgctgggatgaaaagagggggcccccccagatgagagggaggcgctcattaaaaacacggagagaccgacgcggcgacccacgaggtaacaacagcgcgcgggagcgcgcggaaacatggctctgcaggttgggaactcatggggaggaaccaaacaccacctcggcgggggggggggaactg

SEQ ID NO: 69609 - DNA, 1533 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccaccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69610 - DNA, 1765 bp, Homo sapiens
ggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69611 - DNA, 1538 bp, Homo sapiens
  misc_feature (18)..(18): n is a, c, g, or t
agctcggtacccaacaancccggacaactgggtcttttgcggctgcagcgggctgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69612 - DNA, 1551 bp, Homo sapiens
ggcattgggggaggggacgggggtcgcggggctattgggggtcccagtccggcttaagacctctgggcgtggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69613 - DNA, 1583 bp, Homo sapiens
  misc_feature (21)..(22): n is a, c, g, or t
  misc_feature (64)..(64): n is a, c, g, or t
gcggcctctgctccctccctnntaggctctgtcccacaatgcacccgagagcaggagctgaaanctctaacacccacagatccctctatgactgcaatgtgaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69614 - DNA, 1603 bp, Homo sapiens
ggcattgggggaggggacgggggtcgcggggctattgggggtcccagtccggcttaagacctctgggcgtggtgggcaccggccttcgccgtcggagcaggggtcccagactcgcacccaaaagtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69615 - DNA, 1834 bp, Homo sapiens
tagcttcttctttttcaatgactatatagattagtagataatgcaactgccactcagtgtatcagtatatactgagtggcatcgataaacaccggtgtttatcgatgccacctggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69616 - DNA, 1645 bp, Homo sapiens
gtgttgagtaggacatatgtgatcagaaatgtacacctttaaccagaggagattcagaatgccttgcaaggcaggatataactccactgaattctggggggaaaagcttccatagattcctcgtaaaacctggtttctacatggcaagtgtgagccgtagcgcgtagatgcagacattaacagctccaggtcagggaaggtagtttcaatcgagcctctaaagaaatcccatgagccgatctggccgatcagttgcgatgcccttggagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69617 - DNA, 905 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttggtctcataggatcctgctagatcacccat

SEQ ID NO: 69618 - DNA, 1260 bp, Homo sapiens
gacacagatggcccaagactagcaacggatttctagccctggccccagataatggttcataggcacgccggtctcttcctcaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69619 - DNA, 777 bp, Homo sapiens
ggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtccatcatttgctcatctaccatgttccgtggtgggtggccctggtatgctcctaacattggcctttccctggaattgctgggtaggaccccctctggatcccgaaaaagcccgggatgcattacaacttggaagccaaacttgggcacaaaatgcacgggaaggcgaacgaaactgcacggcgattc

SEQ ID NO: 69620 - DNA, 1953 bp, Homo sapiens
ggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69621 - DNA, 1084 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagcttccagtgcaccctgaagacccagtgggctcagggggcccagctctcccatcagagctgtcctcagggctggagctggggctgggggtcga

SEQ ID NO: 69622 - DNA, 1629 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaaggtgagggaggtgagcctgcagcacctggtcacgaccacagtgcacggccaccctgtctacagggctgactcagagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69623 - DNA, 1575 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgccctgtctctctctgttgtagcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 69624 - DNA, 884 bp, Homo sapiens
tccggaagtcccctttggaacgacttattgttgtgacctgaaaatgttaatttgaagatgtggggcagggacagtgacatttctgtagtcccagatgcacagaattatgggagagaatgttgatttctatacggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69625 - DNA, 1220 bp, Homo sapiens
tgttgctccccagtgcctgcggctggacttttaacatgtaccttgagcaaaggggcctgacttcactgaccaaggctggtacttgtcttttaacctggaccgccggctttgctaccatctgggttcaatcccacttcataccggatgacatcattgatcggcttctatacgctgactaggactacccaccatgcttacccagatccggtcagaccatcattgctacccacactggcctggacatgaacgtgagaaccacctggcggatcatgtccattaaatgtctgggcgtgctatacagcttagaaggcacctttagaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69626 - DNA, 663 bp, Homo sapiens
  misc_feature (25)..(26): n is a, c, g, or t
actactactactaaattcgcggccnntcgacacttcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaaaaaaaaacacaaagtcgacgc

SEQ ID NO: 69627 - DNA, 453 bp, Homo sapiens
aaaatgtttccccacccccccaaaaagtggttcccccccccttgggcccaaaggggggggggaagaattgaaaaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69628 - DNA, 371 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69629 - DNA, 484 bp, Homo sapiens
agtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccaacttgccctggacccggcttgtttctctttcttcctgc

SEQ ID NO: 69630 - DNA, 1457 bp, Homo sapiens
aggctgtactggtccgaagtcttatgatgcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69631 - DNA, 1560 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaaaaaaaaacacaaagtcgacgc

SEQ ID NO: 69632 - DNA, 1734 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69633 - DNA, 1596 bp, Homo sapiens
ctcagctcactgcaacctctgcctccctggttcaaggaattctcctgcctcagcctccagagtagctgggattacaggcacctgccatcatgcccagctaatttttgtatttttagtagagacggggtttcaccatgttgcctaggctggtctcaaactcccgggctcaagcgatccacccgccttggcctcccaaagtgctgggattacaggcgtgagccaccgcgcctggccagaataatcttaagggctatgatgggagaagtacagggactggtacctctcactccctcactcccaccttccaggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69634 - DNA, 1983 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgagtatgtctgaagaccctttcgctcttggtgggtggatggggtggggcagggtctttgggccttccactgtgctaagcagaacgcaagggctccacaggcttgtaggggggccgtggatgagtccttaatcctcatcgtgccagaagggaaggctgaactgccttctctcatcagactcattcctcagcctcacgagcagacctccctgacaggcgctcacaacactgcctctcaagacgagtctgtctgacctgttttctcatcttgacctaacttgctaaatgctcctgggcaagtcactccaccctcggtcagctcagacctcttcaggcctcagagaaagtcaacagtgctgcgccatcccagcttgcttgcaaagggatcccttggttggggtgttggggaaggcagggttttaacggaaatctctctccatctctacagagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69635 - DNA, 1478 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69636 - DNA, 1029 bp, Homo sapiens
ggcagtgcccaccggttgttatatggcgtgctagtcctgactcctagaggagtacccccctgcctgacctcccaaagctgctgggattacagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69637 - DNA, 1239 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacagcctctggagttgtctggtcagatgtgccggtccg

SEQ ID NO: 69638 - DNA, 987 bp, Homo sapiens
  misc_feature (985)..(985): n is a, c, g, or t
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagataaaccagctgcccttgcccgaatatcgtggggtngc

SEQ ID NO: 69639 - DNA, 160 bp, Homo sapiens
agtgactagccctgcccaacccctgggtcctggctggggtggccaggaaggggtagcggggcagtgcagtgtcgggggagagcggcttgctgcctcgttcttttcttgcaggccccaggatgcaggccctggtgctactcctctgcattggagccctcct

SEQ ID NO: 69640 - DNA, 359 bp, Homo sapiens
agctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaa

SEQ ID NO: 69641 - DNA, 431 bp, Homo sapiens
agtggcgcgatgtggggaaatctgctgcccccctggccagtgcctggggatgccagcagaagtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaagggtgagcgcgtctccaattctttt

SEQ ID NO: 69642 - DNA, 642 bp, Homo sapiens
  misc_feature (25)..(26): n is a, c, g, or t
actactactactaaattcgcggccnntcgacacttcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69643 - DNA, 1539 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69644 - DNA, 907 bp, Homo sapiens
  misc_feature (876)..(876): n is a, c, g, or t
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggattgaaaggcggnggcccttttgaccaggggacagggggacaaa

SEQ ID NO: 69645 - DNA, 331 bp, Homo sapiens
gacacaggctggttaaggtgatagtccagcgggaaggtgaggtgggcaggctgcagccctgggctgggggtggttcccgccccatcctcgttccactcaaagccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69646 - DNA, 1456 bp, Homo sapiens
cgctaggtacgagctggtgttatcggccgagggagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69647 - DNA, 1870 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaaaaaaaaaaaaaaaaaaaaaaaaaaaaaaaaaaaaaaaaggggggggcgccgcccaaaaaaaatatcccccacagaagcgcgcgcaagaatttacggcggtccccagcagattatctgttgtggctcaacagaggggggcccccaatatagcgggagccgcataaataaatagacccaaggccgcagggcggccgccacgtttataaacaacaggatgcgtagcactgcgggacaaccggcgacagcgcggggggcaacccgggggcagaaaggaacacccttccacacggggggggggggagcaaccacacagggcggccaaaagccgccg

SEQ ID NO: 69648 - DNA, 1186 bp, Homo sapiens
gtctagccgatccgttaataggttcgcaccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69649 - DNA, 1486 bp, Homo sapiens
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69650 - DNA, 1248 bp, Homo sapiens
atctagcaggatcctcttcgacggtgtctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacaccgtcgaagcttcgactggtgttctgcccgcctcgacctcccaaagtgctgggattacagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69651 - DNA, 1044 bp, Homo sapiens
  misc_feature (30)..(30): n is a, c, g, or t
gaagagaggaccgtgaggtccccatgatgncggaccctaaggctgttttacgctatggcttggattcagatctcagctgcaagattgcccagctgcccttgaccggaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaa

SEQ ID NO: 69652 - DNA, 1212 bp, Homo sapiens
  misc_feature (1048)..(1049): n is a, c, g, or t
  misc_feature (1053)..(1053): n is a, c, g, or t
  misc_feature (1068)..(1068): n is a, c, g, or t
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagacggggtttcaccgtgtttgccaggatagtctcgatctcctgacctggtgttctgcccgcctcgacctcccaaagtgctgggattacagagctgcgcataaaatccagctttgtggcacctctggctgcaagagatcaacaactgggtgcaggcgcagatgaaagggaagctcgccaggtccacaaaggaaattcccgatgagatcagcattctccttctcggtgtggcgcacttcaaggtggtaacannagtngactcagaagacttnctcgagattctactggatgaaagagaccggagggtccatgatgcgcctaggctgttacctatgtggatcaactagtgagatgcagtgctgacgagctaatattctctgctgaaggacaatgctgtgagagcactcgtattgcta

SEQ ID NO: 69653 - DNA, 294 bp, Homo sapiens
cacagttttgcaggctggaagtccaacataaaggtgcaggcagggttggcttctggtgaggcctcgattcttggcttgcaaacagccgccttctcactgtatcctcacgtggcctttcctctgtgcatgaacactcctggtgtctcttcctcttcttagaaggacagcagtccgactgggttagggacccaccctatgacctcatttaaccttaatttcctctttaaaggccctttctccagatacaatcacattggggattagggcttcaacacaggaatttggggtaggagg

SEQ ID NO: 69654 - DNA, 363 bp, Homo sapiens
aacaaaaaaccccccaccaaaaaacaaagaaacccccttcagattggttttatcccaccattttaggtgagtatttccagctgttagagctgtgtgattatgtagatagggatgtgtgggtgtgtgtttgaagtagtaagaatatacccaggagtcagttctgtgagtgctcactgcttgtgttcagttgctgtggtgtatgttccctaaatagattgaagcctgtcaatctgcacaatcaggtataagagccttgtcttgaattctgagtgggaatgaaggaagagtgagtgaactatccctgatagaactcaaacaggattagctgcattgtgaatttgagatttggccatttcccataaa

SEQ ID NO: 69655 - DNA, 322 bp, Homo sapiens
ccatttggtttatagcacagattaggcctgatatttcttcgttggtttttctgtctggaagatttattcaatgctgaaagtggggtgttgcagtctctaggtattattatattggggcctgtctctttagctctaataatactggcttaatatatctgagtactccagtgttaggtgcatatgtatgtaacattcttatatcttcttgatgaattaacctcattattattttttttttttttttttgagacggagtttctctgagtttcgctcttgttgcccaggctggagtacaatggtgcaatctgggctccctgcaacc

SEQ ID NO: 69656 - DNA, 382 bp, Homo sapiens
gaaaaacatttgctaagagatgagtcctgctacagagatatataaagagctaaatggacctataggcctgcacatgtgtgtgggagtaggaaggtgtgtggggttgagggcaaatattcacaggaagtggcatttgagctgcatcttgaaggattaatagcaggtgttttctaaggaaagaaggaagattaagaacattccaggtaaaagagtcatgttttaagaccttggttatgatcatgtctgaagacaggagagaatggcagctgggcgtggtggctcatgcctgtaatccagcactttgggaggccgaggtgggaggatcacttgagctcagaagttcaagaccagcctggccaacatagtaagaccccattacata

SEQ ID NO: 69657 - DNA, 1273 bp, Homo sapiens
cgcgcagagagggcggaccgcgcgaagggggagtgtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcggtgagttgaaggccgggtctgggtatccgctgggcgggccggcgcggggcaccgagcgccctccgggtcgcagcttctgaggccgcgggcacgggccaggcctagcagcggccgccgggagtcgttctggggggccgggagaccagctgcctttctcctccattccgaccccccagctccgcgttgagagctgaacgcgaagggccggatgtggggatcctgggaagagcgttccctgggattccctttctcactctagcgaggaggacttgcacacgttctggaacacttccccaaatatggtccgaggaaagaagtccctagtgccatcccacccctgctttcccccctcgccgactctttgggagctacaggtagtgctgtgggtaaaggttggctcttctccctccatcacttgggtccgacccaaccttatcacaaggcgggggctgctagtctggctctacgcaagtgaggctaatcctgagtggacaaccctgccttagagatccttcatctcttcagattaggaatggaaaacataatgagacccaacagcaactttatccattagagaaaaaagccaggcaggtttgccttttctctagacattcaaggatctgctaccaatgcctgtaaaacttaaaggtcattcggagttgaagtgcttccagaacacggttaatttcttctgagagcggaaggtgcgggtactccacactttacatcaaacagtaaaaaatcatgaaaatggaatttctgtatggcgataaggtgtgtgtgtgtctgtgtgtttgtgtgtgcatgtatacacatgcatatatatgtgtgtatatatgtgtcagaatggttgtgaaataaaagttggtttgcctttgtaaagttcatatatttttataattcagaatgtccaaataacagatggtatt

SEQ ID NO: 69658 - DNA, 4484 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69659 - DNA, 4317 bp, Homo sapiens
agcggaatatcggagtgaggtccacagctagcagtaagagctggtgtaattgaaagacgtttaggtgcaatcattctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69660 - DNA, 4264 bp, Homo sapiens
  misc_feature (9)..(9): n is a, c, g, or t
agcgggtgngctccttgccaggttcaacatgggatgtctgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69661 - DNA, 4365 bp, Homo sapiens
agcggaatatcggagtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69662 - DNA, 4555 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaacaaagatctatttcaagccaactgtttcctcctcggtagagaagcatttgacaactttttttttaattgagtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69663 - DNA, 4500 bp, Homo sapiens
gctacggaagatccttgcgattgctggaagaaatcgtgccttcagaaaacataagagcaatacttgaaaaatcactatataactcttggattaatctgatgtactatgatatctcatgctagcatatgctgcttctagggctctctaaaaaccttcgttttctgtgtgctgcatgctccagtgtgtgtgtttacaccatcggttcttctccctctagagattagcataactccctttgctgttggattgttattttgagcaatatgttttggaaaggttggttttcatcatgagtgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69664 - DNA, 4685 bp, Homo sapiens
cgcgcagagagggcggaccgcgcgaagggggagtgtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaaattataaaaatatattttttatatattaatatattttattattataaaataaaaacttcgaggggggccccggtcccaatttcccctttagggggtcgtttacaatcaatggcccgcgttttacacattgagactgg

SEQ ID NO: 69665 - DNA, 3742 bp, Homo sapiens
tagcaccagctccactagggccatagatgccccctcctttgtgcctagctcctgcgaatccaccgagtgcctgagaccatagcttctactgtgcccacccaggcagagaccctcggccccctctcctccatttctgagcccccatggccagatcctgggcagggaaatgatcctttcaggagacaaccagagcacctcagcgtgggttctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69666 - DNA, 1648 bp, Homo sapiens
agcggaatatcggagtgaggtccacagctagcagtaagagctggtgtaattgaaagacgtttaggtgcaatcattctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaaatttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactca

SEQ ID NO: 69667 - DNA, 657 bp, Homo sapiens
gattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaattgattgagtcgtgaattctacttggtgccctcatctcctgatttattttccgctgatacaagagatgcttataga

SEQ ID NO: 69668 - DNA, 4548 bp, Homo sapiens
cgcgcagagagggcggaccgcgcgaagggggagtgtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69669 - DNA, 4591 bp, Homo sapiens
gttcgaacattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69670 - DNA, 4548 bp, Homo sapiens
gctacggaagatccttgcgattgctggaagaaatcgtgccttcagaaaacataagagcaatacttgaaaaatcactatataactcttggattaatctgatgtactatgatatctcatgctagcatatgctgcttctagggctctctaaaaaccttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69671 - DNA, 4524 bp, Homo sapiens
gctacggaagatccttgcgattgctggaagaaatcgtgccttcagaaaacataagagcaatacttgaaaaatcactatataactcttggattaatctgatgtactatgatatctcatgctagcatatgctgcttctagggctctctaaaaaccttcgttttctgtgtgctgcatgctccagtgtgtgtgtttacaccatcggttcttctccctctagagattagcataactccctttgctgttggattgttattttgagcaatatgttttggaaaggttggttttcatcatgagtgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69672 - DNA, 4429 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 69673 - DNA, 1815 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaaatttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactca

SEQ ID NO: 69674 - DNA, 1949 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaaatttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatt

SEQ ID NO: 69675 - DNA, 682 bp, Homo sapiens
gggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69676 - DNA, 616 bp, Homo sapiens
ctggggggagccggggtgcaagagggcaggctggatcaggccgggcagaagcggaccgggctccgagtgtcaacgagagctagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69677 - DNA, 821 bp, Homo sapiens
gggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggtgagtcatgggggaatgggcttgggagtgggggcgtgcatggccaccgcccaggaggtaagctgtgggaggcaagccccagggatacaagacaagggccctgggtgctgccatgggctgagcatgtgtcttcctgcaggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69678 - DNA, 1372 bp, Homo sapiens
ctggggggagccggggtgcaagagggcaggctggatcaggccgggcagaagcggaccgggctccgagtgtcaacgagagctaggtgacgaggaaattgggggtgggggccggagctgtccggagatgccgcagggggagggttctcacgccgcacggggcggagtcctgggactcggggcgggacgtggaaccgggacgggtgggacctccgagctggtgccagtggaaggcggagcccggcggcggggggcggagctaggagggtcgggggacggagcctggctcttgaaggaggagctggaggaggtgaaaggcggagcctcggggtcggaagcagagggggacggagcggaggcgctgggggcggggcttcagccggtgagtggcgtggctacggctccggaaaaggggtctagttctgtcgaaggcggggctgcaggcccgggggcggtaccgcgtcctccgaagggcggtgccaaggagccaagtgaggagcctggcccgagtaatggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69679 - DNA, 1935 bp, Homo sapiens
ctggggggagccggggtgcaagagggcaggctggatcaggccgggcagaagcggaccgggctccgagtgtcaacgagagctaggtgacgaggaaattgggggtgggggccggagctgtccggagatgccgcagggggagggttctcacgccgcacggggcggagtcctgggactcggggcgggacgtggaaccgggacgggtgggacctccgagctggtgccagtggaaggcggagcccggcggcggggggcggagctaggagggtcgggggacggagcctggctcttgaaggaggagctggaggaggtgaaaggcggagcctcggggtcggaagcagagggggacggagcggaggcgctgggggcggggcttcagccggtgagtggcgtggctacggctccggaaaaggggtctagttctgtcgaaggcggggctgcaggcccgggggcggtaccgcgtcctccgaagggcggtgccaaggagccaagtgaggagcctggcccgagtaatggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctaggtaagaggcccctcctgagggtgcagagcgagtttggggtgtgtgactgggaagggtgaaagctgcttcagcttttcattggtcttcaccgtatccattcattacaatacatgcctcctccaagtttggctgtgtctagcagtgagtacaggggcaatatcattgaagcactcagctgtagtggccccactctgcccttgccaggcctttggcacccccttcccatctccattacccttctccatttctggccttcttgctgagaggggcggaacactctccctttgcccacactggaagggagcttggccatcactgactgtttctttgtgcatcttcaacagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69680 - DNA, 1555 bp, Homo sapiens
ctggggggagccggggtgcaagagggcaggctggatcaggccgggcagaagcggaccgggctccgagtgtcaacgagagctaggtgacgaggaaattgggggtgggggccggagctgtccggagatgccgcagggggagggttctcacgccgcacggggcggagtcctgggactcggggcgggacgtggaaccgggacgggtgggacctccgagctggtgccagtggaaggcggagcccggcggcggggggcggagctaggagggtcgggggacggagcctggctcttgaaggaggagctggaggaggtgaaaggcggagcctcggggtcggaagcagagggggacggagcggaggcgctgggggcggggcttcagccggtgagtggcgtggctacggctccggaaaaggggtctagttctgtcgaaggcggggctgcaggcccgggggcggtaccgcgtcctccgaagggcggtgccaaggagccaagtgaggagcctggcccgagtaatggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69681 - DNA, 329 bp, Homo sapiens
gtaagtgtggccccggagcccgggggagagggcggtgacccgggacaaaggggatcccccggggcaaggaagatacagtggcggtggaaccctcctgttacctacccgtgttccatactctccctgccctcccccacgttcagtcggtcggtcggggtctgtgcccacagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcct

SEQ ID NO: 69682 - DNA, 396 bp, Homo sapiens
accagagagtgcttgggagtctggttctccataagccagggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69683 - DNA, 1591 bp, Homo sapiens
ctggggggagccggggtgcaagagggcaggctggatcaggccgggcagaagcggaccgggctccgagtgtcaacgagagctaggtgacgaggaaattgggggtgggggccggagctgtccggagatgccgcagggggagggttctcacgccgcacggggcggagtcctgggactcggggcgggacgtggaaccgggacgggtgggacctccgagctggtgccagtggaaggcggagcccggcggcggggggcggagctaggagggtcgggggacggagcctggctcttgaaggaggagctggaggaggtgaaaggcggagcctcggggtcggaagcagagggggacggagcggaggcgctgggggcggggcttcagccggtgagtggcgtggctacggctccggaaaaggggtctagttctgtcgaaggcggggctgcaggcccgggggcggtaccgcgtcctccgaagggcggtgccaaggagccaagtgaggagcctggcccgagtaatggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69684 - DNA, 623 bp, Homo sapiens
gggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagtggccttctcatggttccacaggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcc

SEQ ID NO: 69685 - DNA, 1476 bp, Homo sapiens
ctggggggagccggggtgcaagagggcaggctggatcaggccgggcagaagcggaccgggctccgagtgtcaacgagagctaggtgacgaggaaattgggggtgggggccggagctgtccggagatgccgcagggggagggttctcacgccgcacggggcggagtcctgggactcggggcgggacgtggaaccgggacgggtgggacctccgagctggtgccagtggaaggcggagcccggcggcggggggcggagctaggagggtcgggggacggagcctggctcttgaaggaggagctggaggaggtgaaaggcggagcctcggggtcggaagcagagggggacggagcggaggcgctgggggcggggcttcagccggtgagtggcgtggctacggctccggaaaaggggtctagttctgtcgaaggcggggctgcaggcccgggggcggtaccgcgtcctccgaagggcggtgccaaggagccaagtgaggagcctggcccgagtaatggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagagggggagaggcccccatcagggaccagactgttccaaaaaaaaaacaaaaaacaaaaacaaacaaaaaaacacttaaaagcc

SEQ ID NO: 69686 - DNA, 352 bp, Homo sapiens
tcagcagtgtgaaaatggactaatacacagggcaactgtccctatgattcaattacctcccaccaggtccctcccatgacacttggggattatgggacctacagttcaagatgagatttgggtggggacatagaaaaccatatcattcagtaataagtcccttatatctgtacagaatattttagttcatgtagcacttcacatttttccctaataattctcacaactagtgtgtaagagaggcaaacagatgttcttattttgcagacaaggagattgactctcatagaaattaaaagatttgttcagtgtggcagaaattgtatgtgattgtgctggctcttgcaacgaa

SEQ ID NO: 69687 - DNA, 739 bp, Homo sapiens
ttatcccccatcatttaatataagatgtattaataatagttaactttatatcacattatttaagttactggatataaaaaaagaaggaacaactcccaaaaaactttgcatccttttctggtgaaaaggttactgtgttttcagttatatgaaagataattgtttcaggttaggtagaaatatatgacttttttttctgcttggagattaaatatggtttaggaaaatgtgtataactgtcaagttttcaagggatagacagtacgatttttgttgtattaacttgacacattaaactgtgatgttgctgtgaagatattttgagaagtgattaaagtccataatcagttgcctttaaggaagggagattatttgaggtaatctaggtgggcctgattcaatcattaagaggacttaagagcatagctgtttcctgaagaggaaacttcacctatggacagcttcagtctacctttcctgaggacccacgtgatggatttcagacatacaatcatgtaagccaagtccccacagtcaatatcttaatatgtatctcatactggttattcttcagtggttaaactctgactgacacagaatatgtgtgtatttatttattatttgtaaattgtttttctatattttcctgttgggaggattatattgtcttattgatttgtaaaggctctttgtatattaaagatatacatcaaatatgttaaaaaaaattttctcatcc

SEQ ID NO: 69688 - DNA, 5282 bp, Homo sapiens
  misc_feature (139)..(139): n is a, c, g, or t
  misc_feature (658)..(658): n is a, c, g, or t
  misc_feature (732)..(732): n is a, c, g, or t
  misc_feature (1044)..(1044): n is a, c, g, or t
  misc_feature (1555)..(1555): n is a, c, g, or t
  misc_feature (1921)..(1921): n is a, c, g, or t
  misc_feature (2189)..(2189): n is a, c, g, or t
  misc_feature (2250)..(2250): n is a, c, g, or t
  misc_feature (2728)..(2728): n is a, c, g, or t
  misc_feature (2846)..(2846): n is a, c, g, or t
  misc_feature (3647)..(3647): n is a, c, g, or t
  misc_feature (3656)..(3656): n is a, c, g, or t
ttcttttctcccatccttttcctcctcctattcttctcctcgtttcttctcctcctctcctctttctccactcctttttctcctcctccttctcttctcctttcctcctcctctccttcacctcttcatctcctcctcnttcttctgctcccgattctcctcctctcctttctcttcgtcttctcctcttccttgtcccctcctcctccttgtccatctcctctactcctccttctcctcctcctccttctcttcctttcctcctttcctctttttctcatcctctcctcctcctctcgtcctcttctcttttcctcattcttttcttcttctcctcctccttttttctccctacttcctcctagcttcccttttctcctctcctctcctggtcctgttgtccccctctcctttttttctccacttcctctcttcttactatcttcttctcattttctcttctagttcttctctttcctcctccttttcttctcttctcctcctcctctttcttcactcctccactcctactccttctcttactgtgccactggccatgccaaacagcacccagcacaagtagtggcaccctcttcagcgctgcgctagaaagaactgatgtgcatttatattagcttttggaggatagtactaatcnggcctaactcaggcggccaagtatatatatatatacgtatatacatatgtatgtatatacgtatgtatacatanatatatacacatatatattatagatatattctatgagaaataatcttgctctgtcacctaggctgcagtgcagtggcacaagattatgactcactgtagcctcaagagatcctctcacctcaccctcccgagtagctgggactacaggcgtggcccatcacacctgactaaattcttttttagtgacggggtctcaacacgttgcctagtctggtctgaaacttctgggcgcaagctctctaatgtttttgcattcatagtctcccttattttaatttctcaagtttttgcaaaattgttacataactatcngcccttttcatagagcgctgtttcttgagccaggtcttctgtccatgcatgtcctcttgagagagtggatgtcagccagctaccctggctgagagggatggggataatacagggatgcaataaaggagacagtgataatttatatgatctgggaccccaggcctcacaccagaactgtctagtatacttttagcaaacaagtgccactgatctgagccttgttctgcccttccactttccactttattacacaagcaggagataggcaagggagaaggcaggatgatgaggagactaaattccagaaaagaaagggctgcgtgcagtaagcagacagttgcccccaaagtggtctgggctcccacttaccttagagacatgtgcaacacttgtgaatagttgttttacaattcttaaatcagtggacagactgtaagcatcccattggtgtcagttgccaggtgcccaatgcctgttctctgcagcaacctttgtggtcccatacctgggngtgagttctgttcctgcagagtgccctgtgcattctggtgcttttgtgccctctcctctaacctataaactgacaactctaactctatattttcacttacaatttttctgaagcagtgatcttttgtcatcttgatcacactacaagtcgctcaccctgcaagtacttgtaaaaatgaaagtaatctccattccttctggaaggtgattgccatgtacacaacctactaggccaggaacattactgatggctgtcctgatgcatgtctctctcacccccatgtccaatcagtcaccaggctctccccaaaaccatgctccggtcactgactttggctgtttaatcacttctgacctaaggtcctcnttgagtcataagtacctcttgagttaattttctgcctccagtttctctctactgctgtttatcttccaccctgctgccagagtcatcatcctcaaaaatgaaagctgctctcattgtttgcctgcctaataacatctcttccctccctgttgtctacaaaaagaaaaatccaaactccttcacttgttttacaaagaccctcatctgcttccaaaccaaattgctagtcttggctcttgtctctgtcttccacatcactgccacactnaataattctttactgcctctgttgttgcacgggttgttctttttgttttgtctccatcccnttcccccagcaaagaatatttactctttactcttctgttgagacccatctcaaatactaccttttctagggaaaattaggccttctgttcctaataacttttacccccatctatcaagtctgtctgctgtaatttatctgttaacatgtttctcccacctcaagaatattttttccatcttctgtacctagcacaattgcatggttggtgctcactgactactacatgttgatttatttattttacttgtttgagaggtggagtcttgctctgttatccaggctggtgtgcagtgatacaatcttggctcactgcaggctctgcctcccggtttcaagcaattctcctgcctcagcctcccaagtagctccgattacaggcacccaccaccacgtccagctaatttttgtattttcagtagagacaggtttcaccacattggtcaggctggttttgaactcctgacctcaggtgagcngcctgccttggcctggcaaaatgctgggattacaggcataagacaccatgcctggacttgcatgctgatttccgatataaaaatgaaatttttgaagattttggagaataccatcatntaaattggaagctaaggcctaactattactacacattcagcaaaggaagtgggtataaactaacaactttggcacatctgtcatgcagtagtttgctgcaaggtggaaaagattttggtgctttggtgggaaatactgttgaattacagaaattctaaaacaaaagctggctcagcttaaagagaaaagaaaatgcttgctaatgcctgcttgcactaaaagctgtcacactgtggcctttaataattctaaacatttttaatggattttggtttgaacttcaaattcaataggaaaaataaatgcacagataaaggacccagatcatttcagagctccaatgtgtgaacccgttttctctacttatttagagttttgtttcactagtggcatgagttaataggagtgttgctttgtacataaattctctttattccataattcttggttttaaaaattgaatgcaataccagaaacctacagggtataaatcttgcttgatgtgtgtgcaatgtacatacttgataataattgattatatatcatatttataaaaagaatcatgtgtactgttttaggagaacatactttaccctgatactttattgttaaaaacaacaaagcattgttctaactactaaaaatcaaaaatttaactttcttttaaaagaggtacatgtatcttcagaaataaaagggatacccagaagataaggtaggtgttctgaaacacgaggtgaaacatttgaatgggttttttttgtcaaacaataaatttttaacaaagaaaagtttgcattntgggtgaantatccttagtatctttatacaagatgaaatcctgattgattaaagatacgttactaactttaaatgtcttttaataagtgcttacatgctaactagtatttagactcatacctggcagatacatttagacataagattctaacttagtttcatttctgaggaggcttgtgtattttcctctgtgatacagaaaatagatttttttaagccattttatcttttactttagagttttaattgtttgttaagtggtttataatggtttaattaacaacccgaacaggttttctgtgatttggttggttaaatctatatgtatttggttaaaatattctacgtcaaagttttaaaccaagagtaacttaaaggagtcttaacttgtgtttctctgaatttgatttgtgtttaaattatgaaattaagttttcaaagaacgatttttgtgttcaaaagcttaaggtttcacaacttaattttcctaagtacaatttttttctatcggacttagcctccttttagaagacagttttttactaccaaatttaccattcccatttttttttttacttttacagatctgtatttagtccataaatatccaaatatctgcttgtgaaggttctgtctttaccaccaagcctaccggtatggcaaagacatacagttgctaatctcattaaagatagatcacaatgagagagactcatctagccatgaacaggtcacttctatcagtgttaactgctcaaagttaagtatgacaagaagctatgaagtaaagtttggcctttgtgtatgggagaggaatggaggatgccaggatgcaggtcaaggaaggcatcctgtggaagtaacatttgagctaatatctgaaggatgtgtgatagaaggaaaaagaatgcttcagagaacagctggtacaaaagccctgaggttgaaaaggtggatgtgtcagggaaatgggggaagtacagtgtctggaagaagaaaagacactgaatgaggtgaatgacaggaatgatgaagtagataggggctagagcagattgtaagaactctggaaagctttgaaaactgttgggccaaaaagtagtatgatgaaatttgcatgctaaggactatttttacccaagtagtaaatagaccaggtagaaggaaataatgattggccttctgtttggaagatcagttagaaggctagtttatgaaaactttgaaaagcagtgatggcctgcagcatcgtgacagtaaagatgggagctcaaatggatttgataaaggtttaagaggtaagagaggcttgctgattggatggtgtggggaagggatagataacttcctgatcttggattttatagctgggtggatggtggtgcctcattgagactggaatgctggattaagcaatgtatatgaacagggcatgttccctaccctttaaagagttatgtatatgttttccatgtttttagctatttctccacttgtaatgtgttttagttggttaaaaattatgtacctggcatggatgacgcattaaatgtacttatgtaactgataaaccaatgttacattcttgaaaataaattacattctatgaaaataaatggctttctcctattcttt

SEQ ID NO: 69689 - DNA, 1010 bp, Homo sapiens
tgctaaaatctcttcactccctaacctgggtcatagtgtataaaaattattattctagaaaacatttaatgagcatttactatgttctagagactgtctcaggttcttcacttatgttagtccactgaatcctctaatagccctatgggatatatgctgttatgatggctattttatagatgaagaaactgagaaacaaaggggtgaagtaacttgcccaagcttctgcagctaggaaatcgacattggttgatcccatgcagtctggcactggagccggtgcccttagccaccatgctgactgactccacaggacacatgagccacatttccatcagtcgagaagacaaaggatcagaataggactccagtgctgctatgtacaatcacagtttctctgattaaaaattgtggaagaccatcccaacggctgcaataagcatgaggtcaaatgcctcccatttaagatcccctactgatatgaccttgtacctggattcacagtgagcaacaccacagccaggccaatctccgagcttttgccgcatctatttcttgctgttcccaaaggcatctccacatggatcagtgcctctaaacacatcctacccaaaagttgatgcaatcacttctctcccagctccattagcagaggttgaagtcctagtaagaattactcatatgtggagatattaagtcctagtaagttgaagtcctagtaagaaatactcagtatattggccaggcaccgtggctcacacctgtaattccagcactttgggaagctgaggtaggtggattacctgatgtcaagagtttgagaccagcctggccaacatggtgaaactgcttctctactaaaaatacaaaattagctgggcgtggtgatgcatgcctataatctcagctacttgggaggctgagccaggagaatcacttgagcctgggaggcagagattgcagtgagctgagattttgccattgcacaccagcctgggtgacaagagcaa

SEQ ID NO: 69690 - DNA, 341 bp, Homo sapiens
  misc_feature (330)..(330): n is a, c, g, or t
ataaatgttattgttacaaacttgtaaatgagtgaaaaaaaagagttgtcaatagcccttcatatgtttgtttaacaaatattaatttcctgtcactctgtgctctaaataagatggaaacaaaaatatatacaacagtgccagtccacagtgcaaacatcaataaacaacaagccaggccactgaattgcttcctccacgttgttaataatgttatcatcgtttattactagtaaacttttgacatagaacctggttctgtttggcccatgaaaaacaaggcttctatgacctaagtggtataacgggggtgaagatggaggcacgggngtctcagcacg

SEQ ID NO: 69691 - DNA, 758 bp, Homo sapiens
ggctcaagagacgccaggcaggtgggactggagttgtcatggaaggggcagggcgcagggcggaaccattgctcgcggagctggcgtcgagtcggaacctcggactgcaggaagtgggagcaccgcggtttcggggaagagaccggggttgagcgtctagcccatctctgcgtgacttccgccagcgtttagagcgttttcggggtccgagttgaagagcaaaaccaagtgaaggaaacttcactaagttcagggtgacaagggaggaagtacagagtgaactattggcatggctcaatccattgacctgttttggttcctgatgaagttttgttaatttaaatgagaaaaataaggacagtgaaaaacagagcgcttaaaaagcactgtctggatatcttcagagggaaaaaggagaaagttaactgaattggtgacacttcgggtctctcacagaggaagattagatgaaggtgaccttccccttcgccaagcagaatctcccatgagactcatgaatcctcttgaggccaattacagctatcacttgttaactgttggagtactttcagtcttaaaagagctgctagaaaattaaggctgcaacatgaaagaagaacaaaatggtcaggcatatcacacgtttttatcaaatgatttggtttaggacttgataacctggttagtacttgagcactgaaagatattttgaatttaaagtaagatggagaaagtgatggaagctaaatcacagagga

SEQ ID NO: 69692 - DNA, 900 bp, Homo sapiens
ggctcaagagacgccaggcaggtgggactggagttgtcatggaaggggcagggcgcagggcggaaccattgctcgcggagctggcgtcgagtcggaacctcggactgcaggaagtgggagcaccgcggtttcggggaagagaccggggttgagcgtctagcccatctctgcgtgacttccgccagcgtttagagcgttttcggggtccgagttgaagagcaaaaccaagtgaaggaaacttcactaagttcagggtgacaagggaggaagtacagagactgcactttaaattctggatgacagacctatcaggactgagtggacctttgagtgacaagatgggggtgttccaaagagaccatggcagcctgcagctaggactttaataaacagagcgcttaaaaagcactgtctggatatcttcagagggaaaaaggagaaagttaactgaattggtgacacttcgggtctctcacagaggaagagaccaccaaaccaacagaagccaccaggacagcacacagccattccaaaattccagaccaggatcattccagaaaagccttacatctcagtccagtatatggatggttttgtaagatgacctatgatttttctgttcctccttcctgcccctaacttcagagaaacagacctagaaagagggaaggaaggagtgaaaaagcgtgccatactttatcttctccccttctgttttaaactagacaaatctatattttaattattataagtaaccagaaagttatatggtctggccaggatggcattaaagaaaatgagagagaaaagtttaagatagcatggttggagacaataagtagaagaaaccaagtagttcaagttttataacgctctatcttataaacactcttgaaccaa

SEQ ID NO: 69693 - DNA, 868 bp, Homo sapiens
ggctcaagagacgccaggcaggtgggactggagttgtcatggaaggggcagggcgcagggcggaaccattgctcgcggagctggcgtcgagtcggaacctcggactgcaggaagtgggagcaccgcggtttcggggaagagaccggggttgagcgtctagcccatctctgcgtgacttccgccagcgtttagagcgttttcggggtccgagttgaagagcaaaaccaagtgaaggaaacttcactaagttcagggtgacaagggaggaagtacagagactgcactttaaattctggatgacagacctatcaggactgagtggacctttgagtgacaagatgggggtgttccaaagagaccatggcagcctgcagctaggactttaattgaactattggcatggctcaatccattgacctgttttggttcctgatgaagttttgttaatttaaatgagaaaaataaggacagtgaaaaacagagcgcttaaaaagcactgtctggatatcttcagagggaaaaaggagaaagttaactgaattggtgacacttcgggtctctcacagaggaagattagatgaaggtgaccttccccttcgccaagcagaatctcccatgagactcatgaatcctcttgaggccaattacagctatcacttgttaactgttggagtactttcagtcttaaaagagctgctagaaaattaaggctgcaacatgaaagaagaacaaaatggtcaggcatatcacacgtttttatcaaatgatttggtttaggacttgataacctggttagtacttgagcactgaaagatattttgaatttaaagtaagatggagaaagtgatggaagctaaatcacagagga

SEQ ID NO: 69694 - DNA, 587 bp, Homo sapiens
  misc_feature (399)..(399): n is a, c, g, or t
  misc_feature (584)..(584): n is a, c, g, or t
gaattcttaacaggacacgtttaggattaaacaggttttactgggggtctgaagaaacttcccagacctccacaaacaagttttattggaggatctaaaggaacttcccaaacctccatgatttagcaggagacaagatgagggtaatcacccccggcacctggacccatttagattaagtacatttactgaggctccagaggaaggtcttcaggactcagaccttagttatagattagaagaagttaatcacttatgtctttagacaaatgcacacttacacatagatgtatagcttagaggttatataagctctggaaaactttgtaatttagacttggtctggtgatactttcccagccttctccctatacccggttacagaagtaaactctcttntttcccagttagtctgcatcttgctattgggccacaggaataagcatctcgaccctctctttggtttgggaaaagtttggctgttgtctgttatgggaaggtctgggaaaagatctcgactgcttaattggaagagtcagaactacagtaaccattccacagactagaacacagaaagaaacagntct

SEQ ID NO: 69695 - DNA, 810 bp, Homo sapiens
aagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaattgtgtgtgtgtttgcttgcacatgtgtgtgttaccattctgcttgcatttctaatagtgtttcaattttagcaacatataggagcaagtgttccagaatgtaatatgaataggagaaatagggaagcagtaaaacaaaatttaacacaagcttgtgtctcttttcctctcatgtgtccaaaagctaatctctttattcactaaaaggaaatgtgtataagactaaatcccctttggctttttaaaaacattttgtgatatcagtgacaatgcagttcttctagccattaatcttgtacccctgtaagaaatttcacctttct

SEQ ID NO: 69696 - DNA, 253 bp, Homo sapiens
cagagtaagaactgtgggacaattacaaatgttgtaatatgcatatggtggaaatattaaatttcccattatataatatattacatgggaattgtccttatgatggcacataacatgatataggaagggaaatagacaaaatcaagattatggaaggatttttttcttgaacacgatctatgtctcagaaagctttaatgacgttccataccaaatattcaagagtatatgcaggctctggaactagaaggct

SEQ ID NO: 69697 - DNA, 304 bp, Homo sapiens
agaagagccaaataaagtcagaagtaaaaaaggaaatacaaaacttatcagagactactatggacaactatacactgaccaactggaaaacctagagcttgatgtacaaaaatccttaacaaaatactaccaaatcgaatccaacagcacatcaaaaacataatataccacaatcaaatgggacttataccagggatgcagggatgattcaacatatgcaaacaataaacatgatacattacatcaacagaatgaaggatgaaaaccatttgatcacctcaatagatgcaaataagcatttgat

SEQ ID NO: 69698 - DNA, 4299 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69699 - DNA, 626 bp, Homo sapiens
gataaatatgtcgaccacgcgcttgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69700 - DNA, 313 bp, Homo sapiens
actagttctagatcgcgatctagaactagtcgacgcgtgggcgacccacgcgtccgtaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69701 - DNA, 293 bp, Homo sapiens
cgcggccgcgcgacgaagacgacagaaaggggggagtaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69702 - DNA, 730 bp, Homo sapiens
gcattctaattttgctgtctttcctgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagaggtagagcttgttctccctgttcctctacaatgttcttttaggttcctaaagacaccaaatgtgtggtcccacacctcaactctgggaattatgttacttaacacctaacaacaaactgttgttcctgctgtggaagttgactgttgaatgagttaggtattggagcatctcacaggatcctgtgataatctatccaagcagcctgtgagaaaaggaaaagaaagggaaacagaaaaggatataatctggaattaaagatcaatctagctggtttcagtggctcacacctgtgatcccagcactttgggagactgagtcaggcagattgtgtgagccccaggagttcgagattagcctgggcaatatggcaaaaccccatctctacaaaaagtacaaaaattaggtgggtatggtggtgtgtgcctgtagtcccagctactcggg

SEQ ID NO: 69703 - DNA, 791 bp, Homo sapiens
catcctcaaacctagccccacaataaaggttcttggatttaggtataccgtgtttactttctgggcatcagtatgactggcccagtatcttgagggggttctttagaaacgttttctctgcttgcagctggtcacttgctctggggctttcaaggaaggttctttgcggatcatccggaatggaattggaatccacgagcatgccagcattgacttaccaggcatcaaaggtagcttttttggtgggcataggatgtagatcttacatgagggactttggccttgttacatgttgtgaaggcgttttggtgggagccagaggaaagcagatcaagtgaagagtgaaagtcgtaacaacagatcagaagcttaaacatatctgaaagtataaaagtaaactttagaaaaaaaaaaaaaagaaaatactactgatcaaaattggtagtggaatagaggactaggggattaaaagattataaattaaaattaatgttgtttatatgaggcaaccgatagaattcataaagaaaggagagactgaggatattttatgaagatataagtataaatgtggtttctagataaaaaatataaatcttcctaaattccaggagaattttaataaaaaaaagatcagaggctaggcgaggtggcgtggctcatgcctgtcattacagcactttgggaggccaaggtggaaggattgcttaagcccaggagtttgagaccagcctaggcaacgtagacctcatctctataaaaaaaattaaaaattagccaggggtgatggt

SEQ ID NO: 69704 - DNA, 4213 bp, Homo sapiens
ttccactacgcttccacgctaggtacgaggcggggtttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69705 - DNA, 4483 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaaaaaaaaaaaaaaaaaaaacaacaaaaaaaaaacgcgggggctttttttggcgggggggggaaaaaaaggtgtatagagagaggcatgggtaaatgttttcctggacccctttttttctgcacgcgggaaatccgcgcggcccaaaggagggaaaatccagacgctgctgtctttgccatcactc

SEQ ID NO: 69706 - DNA, 4318 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagtcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69707 - DNA, 3959 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69708 - DNA, 3604 bp, Homo sapiens
gcctacggttcgatctttgcctatttgctttgtctacaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69709 - DNA, 3013 bp, Homo sapiens
ttcgggcacaggagggggcgcctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69710 - DNA, 2804 bp, Homo sapiens
gccggggttgatggcgagggggtcgtggatgatcagcagactttcttctgtggcaacgtggctcatcagcagcttatccagtcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69711 - DNA, 4275 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcggcgtactcggacagacaacgggcacggctgccatggcagtccggatctcccaaacagacacaccgcccc

SEQ ID NO: 69712 - DNA, 4345 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcgagctgccttttttggttagcgtgagttgtgttttctgtggtctgggcgttctgcactcctctcctcgtcccctgggttgtgtttgtatattaaatgtgctgttcttgtgttgtgtgttgtgtcgtggtgcgtgtgtctc

SEQ ID NO: 69713 - DNA, 4222 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69714 - DNA, 4379 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaactgccttcttcggaaagaagaaggtgggaggatgtgaattgttagtttctgagttttaccaaataaagtagaatataagaataagaagaaatgatattagattcctcacttattagctcttctagattttctcccttatcaatatatatcctcgggtgggggctcgttcccaattcgccctataggagttggtttacattaacttgcctgggctttacacg

SEQ ID NO: 69715 - DNA, 4179 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69716 - DNA, 3996 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgaaatgtgcggccggcggatcctcagagtcacctcgc

SEQ ID NO: 69717 - DNA, 2537 bp, Homo sapiens
cacgcgtgcaccttgattctgtggtcgtctagagttggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69718 - DNA, 3902 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69719 - DNA, 3725 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccaagtaaatggcagggatcctctagaacacc

SEQ ID NO: 69720 - DNA, 4003 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgaatagcaccctcaccattggcaccatcgatgagatccagaagctgcacattcgcacagttcccctctatgagtctccaaggaagatctgctaccaggaagtgtcccagtgtttcggggagggctgggagttccttggtctctggtggatgcaagcattgggttctgtgtcaggttcaggtgctcctgtttacagagatagaactttcctcgtcagagaataaaaggtgacagaaatccacctctttagactggctcccctactgtggagtatgtcagctccccagggaaattgagcaccgtgaccactgcacgtggtcctgtctcagggcctgtggtggaaacaggaggttcagaaagtgactttcttaccgcctttcagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69721 - DNA, 1788 bp, Homo sapiens
gccctcagtctgcagaaactggtgggcatgaagcacttcaaaggtgtgttggtcaatgataagtaggttgtgcactgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69722 - DNA, 1750 bp, Homo sapiens
gcctcgtgccgaatcggcacgaggcacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69723 - DNA, 3305 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaacttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69724 - DNA, 3592 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacataaccgagcgtggcaataatttacaaggggatttagagggttctgtgggcaaactttaaggttgaactaagattcgatcttggacaaccagctatcaccaggctcggtaggtttgtcgcctctacctataaatcttcccactatttgcacatatcacgcgc

SEQ ID NO: 69725 - DNA, 1368 bp, Homo sapiens
ggattgagataagcacggtggattgagataagcacggtgcgctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69726 - DNA, 601 bp, Homo sapiens
gctgcctagaggatccctcctacgagcgcagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69727 - DNA, 2291 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaccattggcaccatcgatgagatcaagaaactaccctgcctccactagacagaacaggcgagagtactgtgatccccaatagacagt

SEQ ID NO: 69728 - DNA, 2198 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaactccgctttgaaaggtaccagctca

SEQ ID NO: 69729 - DNA, 2094 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacaagctttggtcagcacttccaggttagttaccacttcattactggagggcactgtcacaaacttctgactatccagacttgaagtgctgtggactctccttaggggaatgtcgggtgcttcttcctcaagcagctcagcactttgtaggagagcatggatctctgggtgcagatcctccatactatcttccctgaggccagtgctctgcagtgcaatacccaggcgacatctggattataaaaatgaaagcaccgacacacactaactgatccacatcccagagcctgagggaactctagatc

SEQ ID NO: 69730 - DNA, 1550 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagaggtagagcttgttctccctgttcctctacaatgttcttttaggttcctaaagacaccaaatgtgtggtcccacacctcaactctgggaattatgttacttaacacctaacaacaaactgttgttcctgctgtggaagttgactgttgaatgagttaggtattggagcatctcacaggatcctgtgataatctatccaagcagcctgtgagaaaaggaaaagaaagggaaacagaaaaggatataatctggaattaaagatcaatctagctggtttcagtggctcacacctgtgatcccagcactttgggagactgagtcaggcagattgtgtgagccccaggagttcgagattagcctgggcaatatggcaaaaccccatctctacaaaaagtacaaaaattaggtgggtatggtggtgtgtgcctgtagtcccagctactcggg

SEQ ID NO: 69731 - DNA, 1197 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaagcctcagcttcgacattttcctgtttccaagggcccttattgaattccttttctcggagagacacctcataggtttttacgtgccgccctgagggtcctggtagacaaagcaaatagtagtgcttgcaaccatataggaactgacatcaatgacatgaggtagagagcctggaaaggatcg

SEQ ID NO: 69732 - DNA, 686 bp, Homo sapiens
  misc_feature (50)..(50): n is a, c, g, or t
  misc_feature (75)..(75): n is a, c, g, or t
  misc_feature (89)..(89): n is a, c, g, or t
  misc_feature (132)..(132): n is a, c, g, or t
  misc_feature (177)..(177): n is a, c, g, or t
  misc_feature (194)..(194): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (259)..(259): n is a, c, g, or t
  misc_feature (262)..(262): n is a, c, g, or t
  misc_feature (267)..(271): n is a, c, g, or t
  misc_feature (274)..(276): n is a, c, g, or t
  misc_feature (289)..(290): n is a, c, g, or t
  misc_feature (292)..(293): n is a, c, g, or t
  misc_feature (295)..(295): n is a, c, g, or t
  misc_feature (299)..(299): n is a, c, g, or t
  misc_feature (301)..(303): n is a, c, g, or t
  misc_feature (307)..(307): n is a, c, g, or t
  misc_feature (311)..(312): n is a, c, g, or t
  misc_feature (317)..(317): n is a, c, g, or t
  misc_feature (320)..(320): n is a, c, g, or t
  misc_feature (340)..(340): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (356)..(356): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (365)..(365): n is a, c, g, or t
  misc_feature (369)..(369): n is a, c, g, or t
  misc_feature (373)..(373): n is a, c, g, or t
  misc_feature (375)..(376): n is a, c, g, or t
  misc_feature (378)..(378): n is a, c, g, or t
aaaatttcatctaaataaaataaccattgcaaatcattaaataaaaaaanaacaaaaattactattattccaatnccctccaatggaantaacaaacagcaaaaaactcaaaacctgaaaatagcgccaacnccccacccaggaagacacaaggcccccgctcagcttccgcttcanggggatgaaagccaggngtgaaaacgagtattaatgcttgaaacaaaaaaaaggacaaaaaatacaagtcaggncntntgcnaangtctnnnnntcnnngggaaggattttnnanntntttncnnnaaangaannggtgnggnggggggtgtggggaggtggngggngngngntcgagngnanangtnagcnaggngnngngggggaggtagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69733 - DNA, 278 bp, Homo sapiens
gtagcggaccgcataaactattaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69734 - DNA, 471 bp, Homo sapiens
caaacattttacattaattttcaaacattcactacttctctgaaatccatccatggactctaggtcagcaatccttggctgattaatgggtcacctgtgggacaaccatattctttcgtcaatagtccccttctggaatcatcccttggaacatgagaatggcagatctagaaactagttattgagagtttcttttggacaataaccatctcttttgggtgggtctgttagggtgttctaggactaacataacattgttctttcttattagctcaacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggag

SEQ ID NO: 69735 - DNA, 120 bp, Homo sapiens
ccccacctgtgggagagcaccctcttggtcctcacagccccgcccatcttctcattgcatatgacgatggcagcggtatgaagcgagaggccactgcagacgacctcatcaaggttgtgg

SEQ ID NO: 69736 - DNA, 424 bp, Homo sapiens
tcctctgaaacactctcctcaggctccttgagctgccagccatcagagttcttggctagctgcagcctttgtgtcctgatctgacgggtcccttcacaatgatgtctcagcacttcttctgtgtttgagaaggatgatgtgcattctctctgtttgcaggctctgtccagcagtgtaagctccagcaagctgttctccagcagcactgctcctcatgagacctcctttggagaagaggtggaggtgcacaacctacttatcattgaccaacacacctttgaagaaggtgcacatgagctctttcgataatttttatctacgccctccctaatccaggctgttctgggctctggtacctgcaaagcctgacagatgtggcagactgtcctaggaggagcagaaaggaggggtgggaattctgtga

SEQ ID NO: 69737 - DNA, 499 bp, Homo sapiens
gagactttaatcccaactggatgagtgctgtggaaatcttggatgatgacaattttctgggggctgaaaatgcctttaacttgtttgtgtgtcaaaaggataggtgagtagtggccagctctgggagtggtggggagggctgggagttccttggtctctggtggatgcaagcattgggttctgtgtcaggttcaggtgctcctgtttacagagatagaactttcctcgtcagagaataaaaggtgacagaaatccacctctttagactggctcccctactgtggagtatgtcagctccccagggaaattgagcaccgtgaccactgcacgtggtcctgtctcagggcctgtggtggaaacaggaggttcagaaagtgactttcttaccgcctttcagcgctgccaccactgacgaggagcggcagcacctccaggaggttggtcttttccacctgggcgagtttgtcaatgtcttttgccacggctctctggtaatgca

SEQ ID NO: 69738 - DNA, 808 bp, Homo sapiens
aaactaggctaggtacgaggcctgggtggttccctctatgagtctccaagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactcctttctggcagatcctttcacaccgtgcttatctcatccggtacca

SEQ ID NO: 69739 - DNA, 450 bp, Homo sapiens
gctgatctgagggactggggagagcaactgtacaagacctaggtgtttactagaaggaggctgcagcacattagccctccctgagctgctcacctgggctgccctttacgtagaggatacatgctgtggggttgagctctctgcagctcactgcctccttcacttcttcagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacggcgttcgcggcgccttgtttatcctcaagagcgagctatgaccat

SEQ ID NO: 69740 - DNA, 4319 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaagagaattcccccccctcctg

SEQ ID NO: 69741 - DNA, 4551 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaagcagcaatcttagatgcctttccgatttgtctctttatgctgtctctccatacaaaaatttcttggggcgccccgttacccaattgctcctatagtgaggcttcttataattaactgcttcgcgtttcaaattcccctttctcctctttgccttattctcttattgtcccttacctctttcgtcgtcgcacattttctatactctcgatgtctataggacaattgtcatgcgcaatatttcgttaaactccg

SEQ ID NO: 69742 - DNA, 4500 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtggcggttcacttggcgttctcggtttacccatacgtgcactcgcaaacacaacacaaacaccagggggccggacaattgcccaaagggcgctacccaccggggcctaaaacacgaggaaaccgggtacacaatgtgtgaacccctgccggaaaaaacgcaacccacagggcatgagacgggatatagaatgacgcacgagtataactgcgtaccggcgcccacgtagacacgcacagcgcaacaagcgcgcatacgcagccagagcg

SEQ ID NO: 69743 - DNA, 2920 bp, Homo sapiens
  misc_feature (30)..(30): n is a, c, g, or t
cggctaggtagaggccggggtgtaatcggncgaggactaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagtcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69744 - DNA, 2740 bp, Homo sapiens
  misc_feature (30)..(30): n is a, c, g, or t
cggctaggtagaggccggggtgtaatcggncgaggaatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69745 - DNA, 4326 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaagtgcgtctccggaagacacggggcgggggaatgggagtccgggttcccccacagggatcagacagagacacccgagggggcgggccgatcacaagggagttataacggaggacccgcgg

SEQ ID NO: 69746 - DNA, 2703 bp, Homo sapiens
  misc_feature (30)..(30): n is a, c, g, or t
cggctaggtagaggccggggtgtaatcggncgaggaccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69747 - DNA, 4070 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggtcttcacagacaatgaaacgtcgacgcgg

SEQ ID NO: 69748 - DNA, 4187 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggtctttccctcctttctctcgtcctcacatcggaccttatcctttatctctccccctctcttgcggtggcctccccgtcccccctgcaccttcttctctgtctttccttcctcctctcactcgccttgccgttctgccttttccgct

SEQ ID NO: 69749 - DNA, 1999 bp, Homo sapiens
aaactaggctaggtacgaggcctgggtggttccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69750 - DNA, 3670 bp, Homo sapiens
  misc_feature (3664)..(3664): n is a, c, g, or t
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctcccccaaaagggccgggaattcaagnttgggc

SEQ ID NO: 69751 - DNA, 2293 bp, Homo sapiens
ttacatgatagacttgagttggtacctgaacattcgtgtccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69752 - DNA, 1763 bp, Homo sapiens
ccggcagctatccggttcactacactgctgtggccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69753 - DNA, 3443 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactcctttctggcagatcctttcacaccgtgcttatctcatccggtacca

SEQ ID NO: 69754 - DNA, 2987 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaagctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69755 - DNA, 1442 bp, Homo sapiens
atgctcttcccatgtgtgaaaagcccgtgaactgtgaccggtctctgaattgtaaagacccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaataagaagaaa

SEQ ID NO: 69756 - DNA, 2205 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccaaaaaagaaataaatattctataaaccttc

SEQ ID NO: 69757 - DNA, 1988 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactattcatatataggccaggcacggtggctatgcctgtaatcccagaatttggaagaccacgtcaacacacgggtacg

SEQ ID NO: 69758 - DNA, 1971 bp, Homo sapiens
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggtagcttttttggtgggcataggatgtagatcttacatgagggactttggccttgttacatgttgtgaaggcgttttggtgggagccagaggaaagcagatcaagtgaagagtgaaagtcgtaacaacagatcagaagcttaaacatatctgaaagtataaaagtaaactttagaaaaaaaaaaaaaagaaaatactactgatcaaaattggtagtggaatagaggactaggggattaaaagattataaattaaaattaatgttgtttatatgaggcaaccgatagaattcataaagaaaggagagactgaggatattttatgaagatataagtataaatgtggtttctagataaaaaatataaatcttcctaaattccaggagaattttaataaaaaaaagatcagaggctaggcgaggtggcgtggctcatgcctgtcattacagcactttgggaggccaaggtggaaggattgcttaagcccaggagtttgagaccagcctaggcaacgtagacctcatctctataaaaaaaattaaaaattagccaggggtgatggt

SEQ ID NO: 69759 - DNA, 993 bp, Homo sapiens
  misc_feature (951)..(951): n is a, c, g, or t
  misc_feature (957)..(957): n is a, c, g, or t
  misc_feature (982)..(982): n is a, c, g, or t
agaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagaacncaatgngtgcccaatcaatggacctatggtnagaaccgtgga

SEQ ID NO: 69760 - DNA, 2284 bp, Homo sapiens
cttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgtaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatatttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactggaagatgaaaataattatatgattaaacaaagaatgtttcagaaatcacaaga

SEQ ID NO: 69761 - DNA, 578 bp, Homo sapiens
aaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttccttggcagatttgacaaatgttggcaatatttttttagaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaa

SEQ ID NO: 69762 - DNA, 1600 bp, Homo sapiens
  misc_feature (444)..(444): n is a, c, g, or t
  misc_feature (1189)..(1189): n is a, c, g, or t
  misc_feature (1311)..(1311): n is a, c, g, or t
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagcngggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcntgagtctgcatcttagggcatcgatcttcctcacaccacaaatctgaatgtgcctctcacttgcttacaaatgtctaaggtccccactgcctgctggagaaaaaacacactcctttgcttancccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 69763 - DNA, 349 bp, Homo sapiens
cagattagatttgatatcttttattaagttgttatcttttattaattttatgtcttttgcaactagcttacactcattttacttaaaagtatgaaggctatattttttatttattttcttcttcatttttttctgatgtcagatttgccattttgtttcccatgtccctttactctatgggtcttgttttaggtcttctgctcacggtgcttcttggaataaggaaagttctctctagaccagagttctgcccaagaatcggggacagaatgagcaagtatgatctggagaagctatcagtttccactttggtatattatctcggaaagctgttgaagcaaatcagcca

SEQ ID NO: 69764 - DNA, 337 bp, Homo sapiens
actagtacctcagcatgtgattgttttaggaggtaaggcctttgaagaggtaattaaagtaaaatgaggtcatatgggaagacttcatccaagatgactgatgtcctcataagaagcacacagacaaagggaggaccacgtaaagacataggaagaagatgaccatctatagggcaaggacagaggcctccaaagaagctgactttgccaacatcttgacttgggacttctagactcaagaattgtgaaaaataaatttcagttgtttaagctgcccagtctgtgatacttcatcatggcagccataacaaactataatacacccgctgagctaagt

SEQ ID NO: 69765 - DNA, 412 bp, Homo sapiens
taacaaatccttgactcatgtataatcctttattaaaaacgcaggtagaggggccgggcacagtggctcacacctgtaatcccagcactttgggaggcagaggcaggcagatcacttgagccgggagatggaggttgcagtgagccaagattgcgctactgcactccagtctggatgacagagcgagagtccatctaaacaaaaaacaaagagacaaaaaaaaaatgcaagtagagataccatctcacatcactcagaatggctattatcaaaaagtcaaaaaataataggcactggcgaagtggcagagaaaaagcaacacatacacactgttggtaggagtgtaaattagtccaaccattgtgaaaagcagtgtggcaattcctcaaagacctaacaacagaaagaccat

SEQ ID NO: 69766 - DNA, 392 bp, Homo sapiens
gatgatagatgaatgcatgaatgaaggtatggatgaatggatggatgggtgaataggtggagatgtggaaaggtgggtgggatgggctgggtggatggatttgtaggaaaaaaaatgtaagctttgatttctgaaaacctagatctccagccttggccttatgctcgtgtctctaattctcctccctctctcatcttggtgtgcatagcccaggtagctgtgagtgcaaagaacaataggataaacattcagcactctcctgtgggtattatttttagtttccatgctgcagaggtcagagtgtcaaataacaaagagagatcttttcttttctctctcaaggaaagaatcggtcatatctgcgtgggcagcagtggaggtgggtgttagtt

SEQ ID NO: 69767 - DNA, 941 bp, Homo sapiens
tgtcaaagcggtggacggtccggaattcccgggagcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataagggtaagtaaggttccattcacctctttattcatctctgtgccatctgtggtcctttggaactggcttctttcacatagcataatgtcttcaagcttcatttgtgttgtagcatatatcagtacttcattcctttttatgctgaataatattatatgaatataccatattttgtttatccatttatcagttgatgggcattggttggttatttctactttttagttgtaatgaatagtgctgctgtgaacatttgtttacaacttcttgcatggacataggttttcattcttttggctatatatgggtggaattgctaagtggaattgatgaaactgctgctaagttattttccaaagtaggtgcaccattttacattcccgcaaacaatgaatgaagtttccaatttttccacattcttgctaacacttactagtatctttttttcactatagccctcctagtagatgtaaagtaaaatctttttattaccaaaaaatttcaaacatacttaaaaa

SEQ ID NO: 69768 - DNA, 1888 bp, Homo sapiens
catggcgtctgtgctgtccagtcataagccggtagtggcggcgacttcccctcaggaagccgggtctccgcctcctcctcccatccagcctgctcggcggcggaggcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69769 - DNA, 1756 bp, Homo sapiens
tgtcaaagcggtggacggtccggaattcccgggagcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69770 - DNA, 1504 bp, Homo sapiens
gagatcaaaaatcaatttttgtccaattctccactctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69771 - DNA, 1706 bp, Homo sapiens
ggacacgtccaacatcagaatggtctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69772 - DNA, 2768 bp, Homo sapiens
catggcgtctgtgctgtccagtcataagccggtagtggcggcgacttcccctcaggaagccgggtctccgcctcctcctcccatccagcctgctcggcggcggaggcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttattttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttattttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttattttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtac

SEQ ID NO: 69773 - DNA, 1189 bp, Homo sapiens
ctctatggatcccccgtccttcatcatacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69774 - DNA, 1791 bp, Homo sapiens
catggcgtctgtgctgtccagtcataagccggtagtggcggcgacttcccctcaggaagccgggtctccgcctcctcctcccatccagcctgctcggcggcggaggcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcatttttgactctgcttttattcatcaaattgctttgatggtggaaatattttctgttgggaggttatttattttaaattggaggattaatgacctttgcacaatctgtttcttgattgggcctgcacaggcttgactcggccactcgactcatcttcctccacgtctgtgatggtcggctcacgttcgtccatgattcaccgttagcatacgcgtccttcacgctataggcgggagtacgtttttgcgtgcatggcgccgtcgggtacctctctccctcgcgcgctggggtcctcgtggcgctacgcgcttaccg

SEQ ID NO: 69775 - DNA, 897 bp, Homo sapiens
tgctctgaggcgactctcagggcttatgccactaacctccagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69776 - DNA, 592 bp, Homo sapiens
atccccgatgttatccccaacaccaaccgaggcagtcagcccaatgacctggggcagtgggcctgaagatcctccaagtttctgatctagataattaaacatgatcatattgtacgggatgtgtttactgtgttgggcgataacgtgatgttatctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacaaaaaaaaa

SEQ ID NO: 69777 - DNA, 1058 bp, Homo sapiens
  misc_feature (929)..(929): n is a, c, g, or t
  misc_feature (934)..(934): n is a, c, g, or t
  misc_feature (938)..(939): n is a, c, g, or t
  misc_feature (945)..(945): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggatgccttggattacccgaggtgggttccccgatttccgatggggggaaggantcccncgcnngggggnttttcactgggaccggggtcctgacagggctccatttccggcctgttggggttagcccgcggggggagaaaaacgtgtgtcgggggcgggagcccgagggaaattgccgcggt

SEQ ID NO: 69778 - DNA, 861 bp, Homo sapiens
  misc_feature (9)..(9): n is a, c, g, or t
  misc_feature (405)..(405): n is a, c, g, or t
  misc_feature (425)..(426): n is a, c, g, or t
  misc_feature (471)..(471): n is a, c, g, or t
  misc_feature (493)..(493): n is a, c, g, or t
  misc_feature (515)..(515): n is a, c, g, or t
  misc_feature (523)..(523): n is a, c, g, or t
  misc_feature (533)..(533): n is a, c, g, or t
  misc_feature (543)..(543): n is a, c, g, or t
  misc_feature (558)..(558): n is a, c, g, or t
  misc_feature (573)..(574): n is a, c, g, or t
  misc_feature (599)..(599): n is a, c, g, or t
  misc_feature (617)..(617): n is a, c, g, or t
  misc_feature (657)..(657): n is a, c, g, or t
  misc_feature (669)..(669): n is a, c, g, or t
  misc_feature (677)..(677): n is a, c, g, or t
  misc_feature (684)..(684): n is a, c, g, or t
  misc_feature (697)..(697): n is a, c, g, or t
  misc_feature (701)..(701): n is a, c, g, or t
  misc_feature (703)..(703): n is a, c, g, or t
  misc_feature (709)..(709): n is a, c, g, or t
  misc_feature (714)..(714): n is a, c, g, or t
  misc_feature (724)..(724): n is a, c, g, or t
  misc_feature (736)..(736): n is a, c, g, or t
  misc_feature (744)..(746): n is a, c, g, or t
  misc_feature (748)..(749): n is a, c, g, or t
  misc_feature (758)..(758): n is a, c, g, or t
  misc_feature (772)..(772): n is a, c, g, or t
  misc_feature (783)..(783): n is a, c, g, or t
  misc_feature (797)..(797): n is a, c, g, or t
  misc_feature (852)..(852): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgacngggcactgctgtttgtagannaaaacttcctggagcagacgatgcccccccccgtggtgatccgtncttaccgaccagtcattggctnctctgctccgccccctcccgcncctccgtntacccgtagncacttcgtgnccagtactctgatgntgccactcatccccnnatctacttcctacaacaccgcactncgtaggaggtcctatttngattgaccccttgaactgactgctgtaccgctggtcccgnttgcggagcctngtaggccngcgcttnccctccccccctntgancncgtggnaccgntcactggcgnaataaaaaaaanaaaaaaannntnnagtggcgtnctgcttcccccggntgtgcaccctncccgtctgaggcgntctctcccgccctctcgccttgtgctgctggcttattctctggcctccccgcccngcgcccgcc

SEQ ID NO: 69779 - DNA, 575 bp, Homo sapiens
  misc_feature (509)..(509): n is a, c, g, or t
  misc_feature (511)..(511): n is a, c, g, or t
  misc_feature (537)..(537): n is a, c, g, or t
  misc_feature (552)..(552): n is a, c, g, or t
  misc_feature (557)..(558): n is a, c, g, or t
  misc_feature (566)..(566): n is a, c, g, or t
gtttttctcccatggagccataagaccaccatcagatctaaaataagatcaatagtcccacctaacaaccacttttattcactcatcccaaatgtctctctttatttttttgagacgggtactttggtggacatgaaggaactgggcatatgggagccattggctgtgaagctgcagacttataagacagcagtggagacggcagttctgctactgcgaattgatgacatcgtttcaggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaananaaaaaaaaaaaaaacaaaaagggggngcggcggcggctaanaaaanntacccccngagggggcg

SEQ ID NO: 69780 - DNA, 724 bp, Homo sapiens
  misc_feature (2)..(2): n is a, c, g, or t
  misc_feature (44)..(44): n is a, c, g, or t
  misc_feature (614)..(614): n is a, c, g, or t
  misc_feature (619)..(619): n is a, c, g, or t
cnacgaaacaagaccctaacggctaggtagcgaggctgggtgtnggcagtgtccagaagacagacaataatcgcattgctagagcctgtggggcccggatagtcagccgaccagaggaactgagagaagatgatgttggaacaggagcaggcctgtaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaacacncaaancaaacaaaaaaccccggggcctcaaatgccgggggcggaaacaggggccaccggactgggccctgggccatagcggtctccggacccagtttcctcgcccacgtg

SEQ ID NO: 69781 - DNA, 552 bp, Homo sapiens
ggttgatcggggtttatcgattacagaacaggctcctctagaggggtatgaagcaccgccaggtcctctgagtgttaggtctaccccaggtagacctaaccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtctacctggccaggtagacctaacccacctttccaatggcataactctctacaggtatgctgcccacagagtgcatgtctgagggctacttgatctacctggggtgttttctcaaagacttgaaccacctctaggtataagccagtgttttttaccagagataaattaatgcctacctttcatatgcatgaccccagagggcacacatggcaccctgtaacaaagagtttacagttgttagtctaccagggtagcc

SEQ ID NO: 69782 - DNA, 1057 bp, Homo sapiens
  misc_feature (3)..(3): n is a, c, g, or t
  misc_feature (888)..(888): n is a, c, g, or t
atngctaagtacgaggccggggttaatcggacgagggggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggcgactgacttggattcacgaangggactcccgaattccaatgggggaatatccccttgggaggattcacaggaacccggtggctccgaaggggctcaataccagcacagtggggcgaaaccggcagggagaaaatatgtacgtggcaacaccaagaaacaggacgggggaaaataatctgagagaaccgag

SEQ ID NO: 69783 - DNA, 865 bp, Homo sapiens
  misc_feature (761)..(761): n is a, c, g, or t
  misc_feature (804)..(804): n is a, c, g, or t
accgaccccccacctactgctaggtacgaggctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaaggataccgggggctcattgagaacccgggtttgcgggggctcngttaacggggtgtgcccctcacgtttggggtttttagaccccntgggggggggtctctgggagaacaagggggacccgggtgattaccagggggtcccttctag

SEQ ID NO: 69784 - DNA, 2131 bp, Homo sapiens
  misc_feature (2065)..(2065): n is a, c, g, or t
  misc_feature (2067)..(2067): n is a, c, g, or t
  misc_feature (2093)..(2093): n is a, c, g, or t
  misc_feature (2108)..(2108): n is a, c, g, or t
  misc_feature (2113)..(2114): n is a, c, g, or t
  misc_feature (2122)..(2122): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69785 - DNA, 2125 bp, Homo sapiens
  misc_feature (2)..(2): n is a, c, g, or t
  misc_feature (2059)..(2059): n is a, c, g, or t
  misc_feature (2061)..(2061): n is a, c, g, or t
  misc_feature (2087)..(2087): n is a, c, g, or t
  misc_feature (2102)..(2102): n is a, c, g, or t
  misc_feature (2107)..(2108): n is a, c, g, or t
  misc_feature (2116)..(2116): n is a, c, g, or t
cnacgaaacaagaccctaacggctaggtagcgaggctgggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69786 - DNA, 2352 bp, Homo sapiens
  misc_feature (2123)..(2123): n is a, c, g, or t
  misc_feature (2126)..(2126): n is a, c, g, or t
  misc_feature (2142)..(2142): n is a, c, g, or t
  misc_feature (2153)..(2153): n is a, c, g, or t
  misc_feature (2160)..(2160): n is a, c, g, or t
  misc_feature (2173)..(2173): n is a, c, g, or t
  misc_feature (2182)..(2183): n is a, c, g, or t
  misc_feature (2185)..(2185): n is a, c, g, or t
  misc_feature (2188)..(2188): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaatctcagactagcttctctccagagacgggggaaaacgactcctatcgcggggaaagggccagccgacccagggtgtccaggatgaccgggatgagctcggggcagcctcatacagtgcagnagnggagaacaccggcggnacaccagcctnatgctgngggactaccgggncacgggtgnnanacnggacgtccagcaaagggtgtaccgtcggccggggaacagccgggcgtgtgctggacaattgtccgctgagatcacagagggtcagatggaaccggtagaccgagtggacgcccggggacacggaagggggacgaacgcgtcaacggaccaaagggacctaaagg

SEQ ID NO: 69787 - DNA, 2081 bp, Homo sapiens
  misc_feature (2015)..(2015): n is a, c, g, or t
  misc_feature (2017)..(2017): n is a, c, g, or t
  misc_feature (2043)..(2043): n is a, c, g, or t
  misc_feature (2058)..(2058): n is a, c, g, or t
  misc_feature (2063)..(2064): n is a, c, g, or t
  misc_feature (2072)..(2072): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaananaaaaaaaaaaaaaacaaaaagggggngcggcggcggctaanaaaanntacccccngagggggcg

SEQ ID NO: 69788 - DNA, 2077 bp, Homo sapiens
  misc_feature (2011)..(2011): n is a, c, g, or t
  misc_feature (2013)..(2013): n is a, c, g, or t
  misc_feature (2039)..(2039): n is a, c, g, or t
  misc_feature (2054)..(2054): n is a, c, g, or t
  misc_feature (2059)..(2060): n is a, c, g, or t
  misc_feature (2068)..(2068): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69789 - DNA, 1995 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatatacagtccttgtggtggcgctcctttctc

SEQ ID NO: 69790 - DNA, 2137 bp, Homo sapiens
  misc_feature (2071)..(2071): n is a, c, g, or t
  misc_feature (2073)..(2073): n is a, c, g, or t
  misc_feature (2099)..(2099): n is a, c, g, or t
  misc_feature (2114)..(2114): n is a, c, g, or t
  misc_feature (2119)..(2120): n is a, c, g, or t
  misc_feature (2128)..(2128): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69791 - DNA, 1765 bp, Homo sapiens
  misc_feature (1555)..(1555): n is a, c, g, or t
  misc_feature (1562)..(1562): n is a, c, g, or t
  misc_feature (1571)..(1571): n is a, c, g, or t
  misc_feature (1764)..(1764): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcctcgggcaagacaccggagactgtgagactggggtggattgggncggtctnggggctgangacggcttgggggcccgggggagctgcgatttagacggggaaggggccggcaagggatgggatcttcgccaaaagggcccaaggcaggggtcgggcacgaggaggggagggtgaaacgagccctcgaaaggaagggggagaagggggccccgcaaaaatgtgtggctaaaaaaagtcggcggctgcgcccggna

SEQ ID NO: 69792 - DNA, 1955 bp, Homo sapiens
  misc_feature (1889)..(1889): n is a, c, g, or t
  misc_feature (1891)..(1891): n is a, c, g, or t
  misc_feature (1917)..(1917): n is a, c, g, or t
  misc_feature (1932)..(1932): n is a, c, g, or t
  misc_feature (1937)..(1938): n is a, c, g, or t
  misc_feature (1946)..(1946): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69793 - DNA, 1998 bp, Homo sapiens
  misc_feature (9)..(9): n is a, c, g, or t
  misc_feature (1932)..(1932): n is a, c, g, or t
  misc_feature (1934)..(1934): n is a, c, g, or t
  misc_feature (1960)..(1960): n is a, c, g, or t
  misc_feature (1975)..(1975): n is a, c, g, or t
  misc_feature (1980)..(1981): n is a, c, g, or t
  misc_feature (1989)..(1989): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69794 - DNA, 2134 bp, Homo sapiens
  misc_feature (2068)..(2068): n is a, c, g, or t
  misc_feature (2070)..(2070): n is a, c, g, or t
  misc_feature (2096)..(2096): n is a, c, g, or t
  misc_feature (2111)..(2111): n is a, c, g, or t
  misc_feature (2116)..(2117): n is a, c, g, or t
  misc_feature (2125)..(2125): n is a, c, g, or t
ggtgacaagcctcagattcagtcctcgagcgagggcacggacaccattgccgccatggtatgcgctcaaagccgtggtgccgccagctttctgctgtggatatgtgagcagaactccggaacaccactgggagcaaaataagtggtaccccatggacttttcttgctcttgcaaagattaatacaaaataatacttcgcagagcatcttatggtcgggctcgcaggacgcaatagatcgtagttgacatatggcgcatcggtcgtagctgtttcgctgaccccagcttacttgtacgacagtgcgtacatctagcactggtctccctatattcgagtcgtcattaatcttcgatcaagccatggttcagcctcgcattatgtagaattcgtgtcaagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69795 - DNA, 1068 bp, Homo sapiens
  misc_feature (899)..(899): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggcgactgacttggattcacgaangggactcccgaattccaatgggggaatatccccttgggaggattcacaggaacccggtggctccgaaggggctcaataccagcacagtggggcgaaaccggcagggagaaaatatgtacgtggcaacaccaagaaacaggacgggggaaaataatctgagagaaccgag

SEQ ID NO: 69796 - DNA, 1021 bp, Homo sapiens
  misc_feature (921)..(921): n is a, c, g, or t
  misc_feature (957)..(957): n is a, c, g, or t
  misc_feature (962)..(963): n is a, c, g, or t
  misc_feature (972)..(972): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggaaggggaagccgactggcttggattaccagaaggggattcccgnattccgatggggaagactccccgctggggattcccncgccnnggttccggngggtccattcgcccattggcatatccccggggcacaatctgcggcgcgc

SEQ ID NO: 69797 - DNA, 1045 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagccgggatcacggaagggaagcccgatggggttgggattcccgggggggtttcaccgcatttcccgtggggggaggctcccccgcttgggcttttacgagcccgtgggtcccgacagggcctttttggccctttggcgtacccggcggagcgaattgtcggcggcgcgcc

SEQ ID NO: 69798 - DNA, 1143 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggcccgcacaggacgctagcagactaccaacgaaaaaggaggaccacaccacagaaataccaccagaatcgagagacacacgtacacatcccaggcaggaacccgagaaggaacacatgaaagcgaagacggaaggccccgaaacgggggacaatcagcgcggaaaaacgagaactactccagaagtagagagtacagacactaacgctcaacagcgagacacacaaaagacagccaacccggcagaagaccgcgcaaaaacagacga

SEQ ID NO: 69799 - DNA, 987 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacctgttgggcggtggtcctctctgatcagaaggaagccgaacgcctggattccgagggtcccgattcaggggaagttcacgctgggattcaggacggggcacgaggattattaccacttggctccccgccgaaaaattcaggcctccgaaaaaaggccgcaagttg

SEQ ID NO: 69800 - DNA, 872 bp, Homo sapiens
  misc_feature (768)..(768): n is a, c, g, or t
  misc_feature (811)..(811): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaaggataccgggggctcattgagaacccgggtttgcgggggctcngttaacggggtgtgcccctcacgtttggggtttttagaccccntgggggggggtctctgggagaacaagggggacccgggtgattaccagggggtcccttctag

SEQ ID NO: 69801 - DNA, 1160 bp, Homo sapiens
  misc_feature (931)..(931): n is a, c, g, or t
  misc_feature (934)..(934): n is a, c, g, or t
  misc_feature (950)..(950): n is a, c, g, or t
  misc_feature (961)..(961): n is a, c, g, or t
  misc_feature (968)..(968): n is a, c, g, or t
  misc_feature (981)..(981): n is a, c, g, or t
  misc_feature (990)..(991): n is a, c, g, or t
  misc_feature (993)..(993): n is a, c, g, or t
  misc_feature (996)..(996): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatgtaattcttctctattgtaaggtttccatttagtttgcttccgatgattaaatctaagtcatttgaaaaaaaaaaaaaaaaatctcagactagcttctctccagagacgggggaaaacgactcctatcgcggggaaagggccagccgacccagggtgtccaggatgaccgggatgagctcggggcagcctcatacagtgcagnagnggagaacaccggcggnacaccagcctnatgctgngggactaccgggncacgggtgnnanacnggacgtccagcaaagggtgtaccgtcggccggggaacagccgggcgtgtgctggacaattgtccgctgagatcacagagggtcagatggaaccggtagaccgagtggacgcccggggacacggaagggggacgaacgcgtcaacggaccaaagggacctaaagg

SEQ ID NO: 69802 - DNA, 1457 bp, Homo sapiens
  misc_feature (9)..(9): n is a, c, g, or t
  misc_feature (1391)..(1391): n is a, c, g, or t
  misc_feature (1393)..(1393): n is a, c, g, or t
  misc_feature (1419)..(1419): n is a, c, g, or t
  misc_feature (1434)..(1434): n is a, c, g, or t
  misc_feature (1439)..(1440): n is a, c, g, or t
  misc_feature (1448)..(1448): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgattctcactctgtcaccatgctggagtgtggtggtgcgatcttggctcactgcaacctctgcctcccaggttcaagcgattctcctgcctcagcctcccaagtagctgggactatagtcacgtgccaccacgcccagctaattttcgtatttttagtagagacagggtttcaccatgttggccagatggtctcgatcctcttaacctcgtgatccgccctccttggcctcccaaagtgctgggattacaggcgtgagccaccacgcctataaagtcaccacaaacactgaattggcaaataataaatcattgcttctataggaaatacagggttagatacctataagcctctggtcacactttcatcaactgataaatatataccttattgtatgtgtttgtcttcaagacacccatttaatatatatagttgatttattagcattgaactcatagcccatagcaatataactcatgcctggacaaagctcacctaacgtattttctctgtaaggcacatcacagccttcttgcacatagaagcattagctagcacttaagcactacacttgtgagccattataaataccgaaatcatcaagaaaaatgtgaaaaacataaccttaaatatactgcataaaggacacttttttttacagtgtgagagctaaaggccttgtttaacctcacctaggaatgtcattgggtgactcaaattttttgccattctgtgaatttccatgaatgactatgaaagtgtcatgaatgttgattttggggttacaaataataagaaatgaaatctttaggataatgaccctgggctatgtaagtttaaagactaatctttctacttcctataggatcataaagaattatttttcaaaaaaaaaacgaaagcgacagaaaaagacaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69803 - DNA, 606 bp, Homo sapiens
gcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagtgagttctggggatgccaggaaatggacccccttttcgccctcttctgtccatacttttcagtgttgccccagctccgtcccccactgaccgggccactgagccttccaatcatcgtcttcattttggaagcccagtgtcccgctttcctctcttctcttaacctgttcgcttctctgcacaaactcaaactggccttattctcgccgagcctctttccttgacgtgtgctcgtcttgggaagctctttcccactccgcgttctgtccctcagcccccacgcttcccccgcccctgcgccctttctagcctgattgtcgctatgtagctgcacgaataacgtttttttttgtttttttttcagttaggtctagctttatattcttggcccatcccttagtagcggtaatttaaatgtttcaatctgtattacggagttaacagtatttcctagt

SEQ ID NO: 69804 - DNA, 307 bp, Homo sapiens
gcctggcctcccaaagtactgggattacaagtgtgagccactgtgcctggccccctgaaaatctttttcaccggacaggcaagacctcttaagtgatgtttccaacaatccacttttgcccttatccctagctacagaccctagagactagggaaatgggtacaagtatctgaaatcatctgattctccccacctcttccgtccattagagcctgtggggcccggatagtcagccgaccagaggaactgagagaagatgatgttggaacaggagcaggcctgttggaaatcaagaaaattggagatg

SEQ ID NO: 69805 - DNA, 1032 bp, Homo sapiens
  misc_feature (890)..(890): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggggaagcccacggnttggatcacgagggggctacgcagttccaatgagcacaaaaccagctgggattacacgaccgggcttacgaggtgcatacagcacatggtgacagccgcgaacaatggaggtcggcaccacagatagacggcgaaaatcaac

SEQ ID NO: 69806 - DNA, 856 bp, Homo sapiens
  misc_feature (2)..(2): n is a, c, g, or t
cnacgaaacaagaccctaacggctaggtagcgaggctgggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagtttgccgagtgggaagatccgggggctcatgaagacccggtctgcggggctgtacacgggtggccctcccgttgggggcttttaaaccccgtggggggtcttccgggttcacgaagggagcggggttgtccgaggc

SEQ ID NO: 69807 - DNA, 1054 bp, Homo sapiens
  misc_feature (2)..(2): n is a, c, g, or t
  misc_feature (844)..(844): n is a, c, g, or t
  misc_feature (851)..(851): n is a, c, g, or t
  misc_feature (860)..(860): n is a, c, g, or t
  misc_feature (1053)..(1053): n is a, c, g, or t
cnacgaaacaagaccctaacggctaggtagcgaggctgggtgtgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcctcgggcaagacaccggagactgtgagactggggtggattgggncggtctnggggctgangacggcttgggggcccgggggagctgcgatttagacggggaaggggccggcaagggatgggatcttcgccaaaagggcccaaggcaggggtcgggcacgaggaggggagggtgaaacgagccctcgaaaggaagggggagaagggggccccgcaaaaatgtgtggctaaaaaaagtcggcggctgcgcccggna

SEQ ID NO: 69808 - DNA, 1137 bp, Homo sapiens
  misc_feature (1037)..(1037): n is a, c, g, or t
  misc_feature (1073)..(1073): n is a, c, g, or t
  misc_feature (1078)..(1079): n is a, c, g, or t
  misc_feature (1088)..(1088): n is a, c, g, or t
gtctaacttgtctggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggaaggggaagccgactggcttggattaccagaaggggattcccgnattccgatggggaagactccccgctggggattcccncgccnnggttccggngggtccattcgcccattggcatatccccggggcacaatctgcggcgcgc

SEQ ID NO: 69809 - DNA, 830 bp, Homo sapiens
  misc_feature (786)..(787): n is a, c, g, or t
ggagaatggtcggaaagagattgctgatgtggtcccatctcagtaattattcttgcaggggagatgggaccacatcagcatttcccctgcaagaataattactgatgtggtcccatctcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttaggtcagcatacttatggggggcaatatcacagcatcgcagagtcggaaaagaaaatcggnngagctgggggccgatagtcgggacaaggatggagagtgctttg

SEQ ID NO: 69810 - DNA, 973 bp, Homo sapiens
gtctaacttgtctggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagctcaaatttgccgagtggaaagatcctgggggctcttgagacccgtgtctgcgcgggtcctgataccggtttgcccccccgtttggcgggcttttaacccccgttgggcggccttctcggacaagggaccc

SEQ ID NO: 69811 - DNA, 2198 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtctacctggccaggtagacctaacccacctttccaatggcataactctctacaggtatgctgcccacagagtgcatgtctgagggctacttgatctacctggggtgttttctcaaagacttgaaccacctctaggtataagccagtgttttttaccagagataaattaatgcctacctttcatatgcatgaccccagagggcacacatggcaccctgtaacaaagagtttacagttgttagtctaccagggtagcc

SEQ ID NO: 69812 - DNA, 2070 bp, Homo sapiens
  misc_feature (1916)..(1916): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggaacggttctgttgtgtacagaaaaggcgaattcaggcttgtgtggtgtgcaagccccccccaagtacctttatctggttcncaaggctcaacgttattccaataaagaaccatttgacgttggttaatactcctcatatggtacgggctaccaattataggtagggttccgaatggattaacagtctagtcagtttggaaaacaaacacaaacgggcggacgcgtaaagaattcc

SEQ ID NO: 69813 - DNA, 1899 bp, Homo sapiens
  misc_feature (1651)..(1651): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagnacgcgccgcacctgcctactgccgaacccgaccgcaccatcgtttccacggccccacacacacgacccggccgacgaccccagagcccccgccaacgtgccgagagcctccctgacatgcctggccccacggacgctgacgctgccacgggccacagggcttacattcccacctggccccaggaaacccaagccaccaagctccaccaccgcaactaccctcgacgccaagcagctgccaccggacaa

SEQ ID NO: 69814 - DNA, 2225 bp, Homo sapiens
  misc_feature (9)..(9): n is a, c, g, or t
  misc_feature (2159)..(2159): n is a, c, g, or t
  misc_feature (2161)..(2161): n is a, c, g, or t
  misc_feature (2187)..(2187): n is a, c, g, or t
  misc_feature (2202)..(2202): n is a, c, g, or t
  misc_feature (2207)..(2208): n is a, c, g, or t
  misc_feature (2216)..(2216): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcattaggtctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69815 - DNA, 2181 bp, Homo sapiens
  misc_feature (9)..(9): n is a, c, g, or t
  misc_feature (2115)..(2115): n is a, c, g, or t
  misc_feature (2117)..(2117): n is a, c, g, or t
  misc_feature (2143)..(2143): n is a, c, g, or t
  misc_feature (2158)..(2158): n is a, c, g, or t
  misc_feature (2163)..(2164): n is a, c, g, or t
  misc_feature (2172)..(2172): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgattctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69816 - DNA, 1675 bp, Homo sapiens
  misc_feature (1609)..(1609): n is a, c, g, or t
  misc_feature (1611)..(1611): n is a, c, g, or t
  misc_feature (1637)..(1637): n is a, c, g, or t
  misc_feature (1652)..(1652): n is a, c, g, or t
  misc_feature (1657)..(1658): n is a, c, g, or t
  misc_feature (1666)..(1666): n is a, c, g, or t
gcggcggggggatgaaaaacttaggctaggtacgaggcctgggtggtgatggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69817 - DNA, 1445 bp, Homo sapiens
  misc_feature (1379)..(1379): n is a, c, g, or t
  misc_feature (1381)..(1381): n is a, c, g, or t
  misc_feature (1407)..(1407): n is a, c, g, or t
  misc_feature (1422)..(1422): n is a, c, g, or t
  misc_feature (1427)..(1428): n is a, c, g, or t
  misc_feature (1436)..(1436): n is a, c, g, or t
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69818 - DNA, 1931 bp, Homo sapiens
  misc_feature (9)..(9): n is a, c, g, or t
  misc_feature (1865)..(1865): n is a, c, g, or t
  misc_feature (1867)..(1867): n is a, c, g, or t
  misc_feature (1893)..(1893): n is a, c, g, or t
  misc_feature (1908)..(1908): n is a, c, g, or t
  misc_feature (1913)..(1914): n is a, c, g, or t
  misc_feature (1922)..(1922): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69819 - DNA, 1902 bp, Homo sapiens
  misc_feature (1836)..(1836): n is a, c, g, or t
  misc_feature (1838)..(1838): n is a, c, g, or t
  misc_feature (1864)..(1864): n is a, c, g, or t
  misc_feature (1879)..(1879): n is a, c, g, or t
  misc_feature (1884)..(1885): n is a, c, g, or t
  misc_feature (1893)..(1893): n is a, c, g, or t
ataggctagtacgagccgcgtgttgaatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69820 - DNA, 1907 bp, Homo sapiens
  misc_feature (9)..(9): n is a, c, g, or t
  misc_feature (1841)..(1841): n is a, c, g, or t
  misc_feature (1843)..(1843): n is a, c, g, or t
  misc_feature (1869)..(1869): n is a, c, g, or t
  misc_feature (1884)..(1884): n is a, c, g, or t
  misc_feature (1889)..(1890): n is a, c, g, or t
  misc_feature (1898)..(1898): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69821 - DNA, 937 bp, Homo sapiens
  misc_feature (871)..(871): n is a, c, g, or t
  misc_feature (873)..(873): n is a, c, g, or t
  misc_feature (899)..(899): n is a, c, g, or t
  misc_feature (914)..(914): n is a, c, g, or t
  misc_feature (919)..(920): n is a, c, g, or t
  misc_feature (928)..(928): n is a, c, g, or t
aagctagtacgggctggggtgaatcggcagagggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaaaaaaaaaaaaaaaaaaaaaaaaaaaaaaaacaaaaaaaaaaaaaaaaaaaaaaaananaaaaaaaaaaaaaacaaaaagggggngcggcggcggctaanaaaanntacccccngagggggcg

SEQ ID NO: 69822 - DNA, 857 bp, Homo sapiens
gcggcggggggatgaaaaacttaggctaggtacgaggcctgggtggtgggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagctcaaatttgccgagtggaaagatcctgggggctcttgagacccgtgtctgcgcgggtcctgataccggtttgcccccccgtttggcgggcttttaacccccgttgggcggccttctcggacaagggaccc

SEQ ID NO: 69823 - DNA, 485 bp, Homo sapiens
  misc_feature (9)..(9): n is a, c, g, or t
aggtggtanggtccggaattcccgggatgggttctctctctccagaaggttctgccggttcccccagctctgggtacccggctctgcatcgcgtcgccatgatgggccatcgtccagtgctcgtgctcaccagaacacaaagcgtgaatctggaatacaagaaaggagaaagccactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagccttggggccccgattagtaaccgacccagggaccttagaaagtttatgttgacaaggccaggcctttttgaatcaagaatttggattaattct

SEQ ID NO: 69824 - DNA, 469 bp, Homo sapiens
tgcttttcaattacgtgtctcagtcatttttgccccaagtgttggcaaatccttccctggtaaattcttttgtaagcctctagtttgtttcttaaaaatcttttgcagtccaacttaagctttaacaccatcatttctgatttgtctggaggggctaatgactgtttatgttaataaaaataatagctattgatatatactaaactttatgaatcttgtacatatttatatatacattgtatggtatatatgttacagcatacactatagattatgttatatgcaatacacactaaatatacataatatagtatagattgcatacagtatgtagattccatatgttatataatattctcatgaaagctttctagggcttatgataagtcaggcactgagctagacattttacatcattttttccgtttagttctcatctcagcccaatgtcaataaaatgaaataaaat

SEQ ID NO: 69825 - DNA, 265 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttccctcgttcctggctcttagcgtggatggacacataacgcaccagcaactcggggatcgtgagagacg

SEQ ID NO: 69826 - DNA, 590 bp, Homo sapiens
ggaaggtagaggaaaagagaaagcggccaaacaatggtttggttgggctgtgtttcagagtataccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69827 - DNA, 8646 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69828 - DNA, 8713 bp, Homo sapiens
  misc_feature (624)..(624): n is a, c, g, or t
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaagggtcagtcgatgttgaggcccacgcgggacatagccgagccagacgnaatttgcgggcaatttggttcttgcgcttgggggctataaacttggttatagctgctgtggacgcgcattcaaagaccatatgtagcgtacactcctttgtactgtacatcgacatgattgggcaccccccagggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69829 - DNA, 8420 bp, Homo sapiens
aagctaaggaaatacaactttcaagggaacaagagacagagtctcactctgccgcccaggctggagtgcagtggtgtgatctgggctcactgcaacctctgcctcctgggttcaagcgattctcctgcttcagcctcctgagtagctgggattacagtgcgtcaccatgcccggctaatttttgtatttttagtggagatggtgtttctccatgttgaccaggctagtctcaaactcctgacttcaggtgattcacccgcctcagcttcccaaagtgctgggattacaggcacgagccatcatgccccgccatcagttcaattaaatctagatatcacattcttcctatccttttttattatacatgtcatgatatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69830 - DNA, 7929 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69831 - DNA, 8367 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69832 - DNA, 7445 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcaca

SEQ ID NO: 69833 - DNA, 2453 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccattcagcccaagcccactgttatgggagaacctttcacagtcaaccctgccttgactccagccaaggacaagaaaaagaaagac

SEQ ID NO: 69834 - DNA, 6928 bp, Homo sapiens
tgactctgaggatccccagtccgttcgactgagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69835 - DNA, 7297 bp, Homo sapiens
cagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69836 - DNA, 3634 bp, Homo sapiens
ccgcccccgattcccgggtcgccccgcgtccgctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69837 - DNA, 1831 bp, Homo sapiens
ggtaccgcttagggcttcgagtgtgcaagagggttacaagtgagtcagcgcttggggctttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaatttagacttagtttgcctttcacacaccacccccacccccaaaatattctaccttctaagttgctttttaaactgtagtgcagccttttgggtaccatatttctttcctgtcagtggtcttcaatagcaaaagttttttttgaaaagggaaatcttgactgggtgatttttttttgaagagggaaatcttgactgggtttccaatttagcctttgtgactctagccgtattgaagaggaatcaccaataggtggcagcagaatctcaagcatgtttcttgggaaaaagtaagggactgagttttgtcttggttctttttcatctgtcttgtcgattccttgtgtttgtttaatatctgcatcctaaactgccagctgcctctaggaattacctgccca

SEQ ID NO: 69838 - DNA, 896 bp, Homo sapiens
cgctcaggagatggtgccaatgctggaggcctggttgctgctattgctcccaagggctcagagaaggcggctaaggcatcccgcagtgtagccggttccaaaaaggagaaggagaacagctcatctaagagcacgaagggagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccttgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcaccccccaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaccacaaatatcggggtgcgcagc

SEQ ID NO: 69839 - DNA, 1912 bp, Homo sapiens
tgtctaggttcagcctactagggagatctgacacacatctgcactgatcaccgagtaaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69840 - DNA, 717 bp, Homo sapiens
gtacatcattatggaggtgctagttgtaatgctttagtgatttaaaatgataaacttttcttttcatacagataaagacacaataaataaaatcagagatttacgaatgaaagctgaagattatgaagtagtgaaggtgattggtagaggtgcatttggagaagttcaattggtaggttattttaatgagaatacaaaaggactttattaaattaaaataatccacttgtgtgtttaacatattatttgggaaaatactgtttttatagaattgttgctttaagttcctttagacattgttgcctgagggtatggaagcctagtgtcaaatctagccatagtgggaagtgttttccccaagtatctgtggcagaaaagaagtgtcaggcatcagaagataaatctttgctcctaatattagactaaaatgctgtagaacagtaagctttataaacaggaagcagcttacatagccgtgtggaggggggaaagtgtcttgtaatataggaaataaaaatttttttaaaacattacttctgataattaaagtcttgacattagctacttggaataatttggcagaagagaagaaataaaaataactgaaacagtaaggctaaattatttagcaagtattcaaagcacttagtaaattgttctgtgaaaccttgagcttaaatgtaacaaaaggttcattattttcccttttcaatttta

SEQ ID NO: 69841 - DNA, 6413 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69842 - DNA, 6260 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69843 - DNA, 6368 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69844 - DNA, 5266 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagccatgtccgataccctgtggcctggcaagtttgcacagcgagaaggtggcatctggagcctcctttccccttctcataacgcctaaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcccctgaataaaatgaaaactttgtttccccttggtaaaa

SEQ ID NO: 69845 - DNA, 6109 bp, Homo sapiens
gaatcttcctaactgctttttctctgagcagatttagaaactttcagaatatttataatcctgaagtttcagcagatccaaattcaaagtaatgaccaagcagggctattaactactccaagactagatctccagatgctggtgaagaatcacagatcatgcagaatttgaaaggtttgtttttgtcatagatagtatatgttctaatgattaataccggaaatctgacaaaggtcaaattctgataatgagaatgttaggtaataatatgcatcacacatgtaattaacttcattttactggattttatagactataatgaaggtcagaagactatcacactcaagtaggctattcaaaagtttgtttgctactaaaataaaacatcactgcttaatcttgtaaaatgtccagaatttaattgcaggccaattaagaatgtacgtaaatggcagaaatttcactttgaaaaaaacaagccaactataaaggacaaaataaagtgaattaaaaagtttccaattttggttgggcatggctgctcatgcttgtaatctcagcactttgggaggccaagatcagaggactttttgagcccaggagttcaagaccagcctgggcaacatagcaagaccccacctcaattttttaaaaaagtacccaatttttatgtgttgagatctctttagttatgaggctaacatcacctgcaagtgtcttttaaaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69846 - DNA, 6358 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttcgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69847 - DNA, 4538 bp, Homo sapiens
attcataagaacttcacagattcctggatagcttattagctgcatgaagtctagaatgtctacaataatataacattatacaatgtcacccattctcacatttcatacaatgtatcaaagtgctatttaagaactgtatatgctcctaagcaattatctcatcggaagagttgatgattttgaggatagtagctcactcagaaggtttcacagtgtagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69848 - DNA, 4344 bp, Homo sapiens
ttttgtgcttcaaaaaatattttgaaaaaaggccataggcttcacttgactgccaaagagatccatggcaccaagaaaggatacaaaactctagttaagtggaaaagtaaggaatgttagtgtttaacactgggcaataagaaatacgtatatttctaatctgtattgcttttgtttttacagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69849 - DNA, 4173 bp, Homo sapiens
acattaaacatgataatgaagcacttgggctgaatgagggagttgcaacatgggaattcgtatgatatctcatagggtatcatgttgataaggagagattgtagcttcagcatatgaaatataatgaggaccggaagaacgagctgtaactaggaaaattcagagataggaagaacatgtggacattgatgtatctattataaagggatccgttggaagcactggaatcaaagtcacggccacgagatccgagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69850 - DNA, 2826 bp, Homo sapiens
agacatttgctgtagttcagcagtgtctgacctgtctttatctagcagtatatttaaaggttactgcctgaaatacgagaatagcaaagaggctggagcttaaacttttgtgtgctttgtttagcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69851 - DNA, 2402 bp, Homo sapiens
agcactgcctacagggaatttcgacaaatctctgcactgatcacctaggtgatgtaactcttgtctaccctctgcctacagggggcgttgtgaaatatctctgcactgatcacccaggtgatgcaactcttgactaggatctgcctacaggaggtattgtgaaatatctctgcactgatcaactaggtgatgtaactcttgtctaagctctgcctgcaggggcgttttcacatatccctgaactgatgacaaaggtgatgtaactcttgcctaggctttgcctacaggggacattgtgacatatctctgcactgatcacccaggtgatgcaactcttctctgtgctctgcctacagggtacattgtgacatatctctgcacagatcacccagtaaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 69852 - DNA, 1730 bp, Homo sapiens
cggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacaggtaaagataaaagtgctttaaattttctcatttgttgagggaaatagctaaaaataactttaacatttcttactctcagttcacccattcttcttccgtatgacataagtgacctttcagaactcaagactctggccaggcgctgcctcacgcctgtaatcccagagctttgggaggccgaggcaggcagatctcttgagctcaggagtttgacaccagcctggacaacatggtgaaacccatctctac

SEQ ID NO: 69853 - DNA, 527 bp, Homo sapiens
gtaatattttttcttattgtggtaaaatatacgtaacatgaaatttattataacattttaaccatttttatatatacagttcagtgggattaaatgcagttcacaatgtatgcaaccatcatcatataagtggaatcatacagtgtttgtccttttgcgtctggcttttttcacttagcacaatgtcttcaaggtttatccatgttgtgtgtgtcagattttccttcctttttagggctcagtaatattccatggtatgtgtataccacattttgttcatccactcatctatcaatggaaggaatattttataatttttatttttaattgttaaaaatatataacataaaatttaccatcttgaccatttttaagtctaagttaatatatttatgatcatattaccctcataaagaaaatgactttggtgaaaccagaaatggttgcattcttttttattgtttacgtttttttgagataggaacttgctctgttgcacaggctggagtgcagcggcatgatcacag

SEQ ID NO: 69854 - DNA, 724 bp, Homo sapiens
gtatgtaaagataatgtatatttacctttcctcctaatgtttgtttctcgtatttttaaactgagtgcatttcttaaattagtttttcccccctccctcaacagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgcttt

SEQ ID NO: 69855 - DNA, 862 bp, Homo sapiens
tccgcccatctcagccttccaaagtgctgggattacaggtgtgagccatagcgcccggctgaatgtgtgtatatttcttaattttaaccactaagactagaagcaataacattttaatagcaatcagcacatctagcattcaaatcttggattcacttttttcttctttaaaaggatacagagctccttggatcaatgcctgattctaggtgcatgcggcagaaagaacaaaatgggtctgagacatctgttgttgttaagaaaataaggaagtctcaactaatgattgagacatgccaaagaacataggagctaactagaagtggctctcagtgacccaaactgagataaattgaacaagggaataaataatgatggcaatagattattcagattaattaaaccaaatacacatgaatccacactaatataaataaataattggataaataagaaaagtgggacaaaggaaagcttttccatacagtagaattctaatcaataaatatagaaagaatagtggaaatagattctcatttcttggcaaataccacataattgttgcagacaagtctgctaaaattagtggatacaattatgagaaacaagatatttacataatctccaagtatctctcaacaaaatactgattttaaaaatggtaactttgaagtggagaaatgtggcagacaatgtcttattcaagtgatcagagttaacgtcaacaatattaggacacaataatatcatgtgcctcctgatatgatgcactgagaaggacaacctcggcattgtggcattcttgccaaaatatattatgtgaatttaaccatgaagaaatattagaaaaaaatcaaacttc

SEQ ID NO: 69856 - DNA, 1074 bp, Homo sapiens
  misc_feature (742)..(742): n is a, c, g, or t
  misc_feature (902)..(902): n is a, c, g, or t
  misc_feature (926)..(926): n is a, c, g, or t
cccctgactagctagacaggtgttacccagtgtcctcaacttactgggtaacacctgtcttgggaatgggcttaacccgtcctttgctttaggaggagaaaaaagcaccctcctgtcacctcctgcatatacacaagaggaacacgtttttaaaactgtgctccataggttcataattacagtaatccatctcctctccgttccttccttaattgtgactggcagtcacgtccccgccctctatgtcagttgagctcaactctgcgcggggcctctcattcctcctcattagtcagtctccttcccctcgccctgtcgggctagtcggggccccgactagcccgacaggtctacggccataccaccctgaacgcgcccgatctcgtctgatctcggaagctaagcagggtcgggcctggttagtacttggatgggagaccgcctgggaataccgggtgctgtaggctttttagacccaaccagccagacagcttcttttctgctggagaagactgtgttgtaatcatttggcatgagaatggccagtggaatgatgttccctgcaattaccatctcacctatacgtgcaagaaaggaacagttgcttgcagccagccccctgttgtagaaaatgccaagacctttggaaagatgaaacctcgttatgaaatcaactccctgattagataccactgcaaagatggtttcattcaacgtcaccttccaactatccggtgcttangaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtngaggcgctgatccctaaaatggcnaacatgtgttttcatcatttcagccaaagtcctaacttcctgtgcctttcctatcacctcgagaagtaattatcaagttggtttggatttttggaccaccgttcaatcattttgggttgccggcttccaaaacattttaaatgaaagt

SEQ ID NO: 69857 - DNA, 639 bp, Homo sapiens
cccctgactagctagacaggtgttacccagtgtcctcaacttactgggtaacacctgtcttgggaatgggcttaacccgtcctttgctttaggaggagaaaaaagcaccctcctgtcacctcctgcatatacacaagaggaacacgtttttaaaactgtgctccataggttcataattacagtaatccatctcctctccgttccttccttaattgtgactggcagtcacgtccccgccctctatgtcagttgagctcaactctgcgcggggcctctcattcctcctcattagtcagtctccttcccctcgccctgtcgggctagtcggggccccgactagcccgacaggtctacggccataccaccctgaacgcgcccgatctcgtctgatctcggaagctaagcagggtcgggcctggttagtacttggatgggagaccgcctgggaataccgggtgctgtaggctgaagggagcaagaaagctgtagctgtgtagggctggcagaatgttgaagaccgcctctgctgctctcacatggggactgggcccagatcctgcttggtcacacccagcccagaagacgggtcctccagttccagtgactctttcagggtgtctatgttgggggatcctctag

SEQ ID NO: 69858 - DNA, 609 bp, Homo sapiens
cccctgactagctagacaggtgttacccagtgtcctcaacttactgggtaacacctgtcttgggaatgggcttaacccgtcctttgctttaggaggagaaaaaagcaccctcctgtcacctcctgcatatacacaagaggaacacgtttttaaaactgtgctccataggttcataattacagtaatccatctcctctccgttccttccttaattgtgactggcagtcacgtccccgccctctatgtcagttgagctcaactctgcgcggggcctctcattcctcctcattagtcagtctccttcccctcgccctgtcgggctagtcggggccccgactagcccgacaggtctacggccataccaccctgaacgcgcccgatctcgtctgatctcggaagctaagcagggtcgggcctggttagtacttggatgggagaccgcctgggaataccgggtgctgtaggctcgggctagtcggggctccgactagcccgacagcacaggacttgtctcaaaaacaaaaagaggtctttctgggacactggacctgcttgatcatctgccttccttgcaaaactcttccccaagccctgtcgggctagtcgggg

SEQ ID NO: 69859 - DNA, 285 bp, Homo sapiens
attgcaccactgcactccagcctgggtgacagagcaagacactgtctcaaaaattaaaaattaaaaaatgagggaagctgctgtatctccacttcttccctctctgtgcccagagatatctcttcagttatctcacatgccctacaagtctagagacctcaggtgaggagccagtagctcagtatagaaactaaggatccaagtggacaactgccaccaagtcaccacagggccagctgctttgggagggtgctgcatctgcctcccatacacttctgccaagtt

SEQ ID NO: 69860 - DNA, 1592 bp, Homo sapiens
ctgagcgcgactcggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccagggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaagaaa

SEQ ID NO: 69861 - DNA, 1456 bp, Homo sapiens
aaaatatttttttttttcccccccggggggaattgccgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccagggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaagaaa

SEQ ID NO: 69862 - DNA, 1450 bp, Homo sapiens
ctgagcgcgactcggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccagggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaagaaa

SEQ ID NO: 69863 - DNA, 899 bp, Homo sapiens
tcattaaaaagagttttatatttgcagaaagacattttcagcctgagtctggggctcccagtggttccctaaatttgagggatggaggaagacttccctgccccaccccaagcctcccgagcctggtggattggtccctgtccccagccaacctggtggcagggtggggcttccgtgctaataacccccctttttccttcttgttagaccctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaagaaa

SEQ ID NO: 69864 - DNA, 1017 bp, Homo sapiens
ctgagcgcgactcggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccagggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctataagtgccctctctgaacaggatgagggcgggttggggcgctagcaagggagagggaggaattcccaggccaggatacacacccctccctcagcttctaaggggtagccagctca

SEQ ID NO: 69865 - DNA, 793 bp, Homo sapiens
gcaggagacagccagaccccagccatgccttcattctgagataaggtagagaccctcctgccacatagcctgtcaccagcgtggaggatcagaatggctgcaccctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaaaaaagaaa

SEQ ID NO: 69866 - DNA, 1130 bp, Homo sapiens
ctgagcgcgactcggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccagggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgtttcacttccgacggaccggtctgt

SEQ ID NO: 69867 - DNA, 471 bp, Homo sapiens
tgaatttaattgaatagaaagaggatgtggtttgtgtctttaaaaaacacacataccaactcgaaacttccttttttgttctttaaaaaacatgtgcataggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacaga

SEQ ID NO: 69868 - DNA, 3462 bp, Homo sapiens
cctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagagagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacaga

SEQ ID NO: 69869 - DNA, 260 bp, Homo sapiens
tttggttgttcctgaaaggtgttaagtaagtgcagttttcatttctctgtcccaacatgattaaagtttagccccctctgaaaaattctttatcaaccaatgctagcatctattggtgatatgctttgtgctggcctcctatttagaaataaacacacaaattaaacatgagacagtaccaatctttaaaatctccccaccagccatcaacactcagaatatcaaatccctaaacacctgaagttgtggcatgcataaag

SEQ ID NO: 69870 - DNA, 249 bp, Homo sapiens
tttcctttcaacatttagaattttaatctcctgtgagatttttttgttatagcatgaagtgtgcaatacatactactatattgtctttatataattttacataaatgggctcacactgtatttaaagttctgcagcttgcttttttcatgtaatgttacctttccaagatctgtccttgttgataagtataggtctggctagtcatttatctctccattcccctagtaaaagacatttgtatctttttc

SEQ ID NO: 69871 - DNA, 547 bp, Homo sapiens
ttccaaaccacagagccaccatctctgtctttctctatctggctctcacctgtgattgaagagagggaaggatgacagagtgcccactgggaatgcctttccacccagttctcaacaggagtcacggcccaggtcagctctgggccagcatcccctgagcacctgctgtctgctagcctgtgtgagctgctttacagaaggacacaccaatgggaagcagcagccctgccttcaggaaggcccagcctgggacagaactgtgcctggcacttggacagagaggcccgggaggcatcagatgccggcccagcccgaggctgcacctcacaataagcccccacctgcaaagaatgtctgtaaatcctggggctctgcacagagcagccggattgcagggaacggcagcaaatcccaggataaaagcagaagccatcctgttgacaattcattcgtgtttctcccccaaatccatccacaacagaactgttaagctcatgtttcctctcctgttgcaaacaattgtaaaaatgattggtatctgccctca

SEQ ID NO: 69872 - DNA, 613 bp, Homo sapiens
gagtgaaactcccagggttgggctgggagtatttggtgcacgcggtatggggagggctgagctcagtgcctcctgggagacttgtcccgtgtacagtgacccagaaagatgagattccttggcctgaactctgtgatagagtgtgactgagctgctgggggacatgtgagcctcaaatccatagaaagacaaacggccaccttgggtgcccaggatactggtgcccggccccacgtacacccacatacttctcagatggctcccacattttaagattttaaaaatgaaaccaaaaaataaattgaagaaaactgtaaactttaagaataatcagctgggcgcagtggctcatgcttgtaatcacagcactttaggaggctgaggcaggaggactgtttgagcccaggagtttgagaccaacctgagtaaggtggcaaaaccccatctctaccaaaaatacaaagattagccaggcgtggtggtgagcgcctgtagtcccagctacttgggatgctgaggtgggaggatcacttgaacctgggagacacaggctgcagtgggccctgattgagccaccacactgcagcctaggtgacagtcagaccctgtctca

SEQ ID NO: 69873 - DNA, 336 bp, Homo sapiens
tccccccctgtttttttcttattccaaagcaatgcaacaaaaagcacaagaaatcaaaaaggaaaaaatagatattggacttcatcaaaatgaaaaacttttgtgcttcaaaggaaatggaaagaaagtgaaaaaacaactgagggaatggaagaaaatattctcaaatcatcatctaacaaaggttgtgttagtctgttcaggttgctgtaacaaaatatcatttcaggtcaccaggtggcttaaacaacagattcagttggccctccgtatccatgggtttcaggccttcgacttcaaccaacctcaaataaaaaatatttttaaaacccaata

SEQ ID NO: 69874 - DNA, 463 bp, Homo sapiens
aaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagcttccaaagtgttattggcaatctagactgccaaatgcataaataggactccatccatgcccaggactgtgcagatgctcaggaaaaacccaagaaagccttaagctctcacttcaagctgatcttgagctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcagagacttcagtgtccaca

SEQ ID NO: 69875 - DNA, 655 bp, Homo sapiens
gcacacaaacctctgcctattaactctttcaaagaacgtttgttggctgcgaaagtcgtctgggttcattgataaaaaaaaaaaaaaagatattgtctttagggctgctgaatatattaatgagttgtcacggaggacagttaggatttgcaaagggtgatagttaccattcacctacttgttgccttaaaagataaaatcatgtgcaaatgaagacagagctttcaggcacctccgccagaacacacttcatttgaggcgacggcagggatgctactaaaaccccaaagagttaagctgaaatggttaatattcctgtctctgcccgcctcctcctgtattctaatgtatgaacccgctcattcagatgtgagtgggacttggggacagcttgccttccctacgcgattgtgtatggcccccgctgaaatgttcctaaaaacacgattttgtaaacgcttatgctccaccagacatccagcgcatctactggatgcccagcgtctacaccagacgcccagcgtcccgagtggggttcactttgtctcttcacacccagggactctcagcctgaggtgagggaaaggaaggggggttattaagaattctgacaaggtaggctgaataaattgtgttttctttgtgagccttaatc

SEQ ID NO: 69876 - DNA, 1789 bp, Homo sapiens
tcacacagacccctgcagacacatctgtgaggcatatgcattcccaaacacacagacagactcatgataaatttgttcctacccagccatgacttctaaatgcttggggaaaccaagacatagtagaaaggagtgtgcaattatcatttcccatgatgccgttacttaagaactctttgtgtccgtccttctaatggcaccaatgcctcccatcaagccttaaacctcacctaaattatgtcattgggctttttcatccataaatgagcataccaggtgccaagggaatcaatatgccatttcacatgccttagaccagtgtccaaagaaagataaaatgttattctataaaagctttctcccagcatttctattcctttacattttgtgccatatacaactatggttttttaatgatcttatttctgacagctgtttttcttcagaacatcaacagcttctttcctaaattagttttagtatgagttccatttctaattagctcaaattaaagtcctagagagcagcgaggtaatatttaaaccctcaggctaaaatttcggagtaggtgcagaatgttgactctaaatgagtttttcctgtgacataacacgcatgaaagcaggatttctttcatgtgtgaaatgtcttaaatcagacttaccctttgtgattctcttttagctttaaatgtcatttaagaagaaaaaagaaaagaaaattaagcatgacattccccaatatcctctgctcactgtgttataatccctatcactccacaagtgaattggagagagtgaagacacaatgaacagaaacttccctgatgcttcacagaggaagtgttctccgggaccacacagcctccaccatgtccatctacgaagggctgtggcaagccatatacacaaagatgcctgtttcctgtcttctcggttaaaaacaaaaacaaaacaccggaaaaagccaagctgccatgggttgcagagtgccagcccttaagtagtgttgttcatgggtaaacaggagacggataagggcaatttcaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggagagatagaggagagttcattagcatcaaaccaccatggatttcataatcaattcctaatatctgaatagatgcagaaaagtcacaggcatctagaagtgtggcccaagttctgttcttcaatcagcccacccattatccctatgtatctcgattttgttatctaaaagatcacatgatggaggatgtaagcaagtaacacagccaagacccagtttacagtgtctagtacctaacagactcttgacacgtttcacttgcccttgagtcagtctttccatgtcactgaatattcttccacaacacgattttaatggatatagtcgtccattgtttaaatgtaccattattgaccaatgtaaaaatgttcttttacctcaaatttttatatgtaaaacaaaaacatgtttgaggactaaacccacagtgtagtataaattaaactggatgtaggccaggcatggtgagtcacacctatagtcccagcactttgggaaaccaagacaggaggatggcttgaagccaggagctcaagagcagcctgggcaatacagcaagacctcatctctaca

SEQ ID NO: 69877 - DNA, 4971 bp, Homo sapiens
  misc_feature (1091)..(1092): n is a, c, g, or t
  misc_feature (1095)..(1096): n is a, c, g, or t
  misc_feature (1104)..(1104): n is a, c, g, or t
  misc_feature (1109)..(1109): n is a, c, g, or t
gggcccggaggactctggagctacctctagctgcagcactgcctctggatggggacttccccatgctgtgggctgtggctccatagcgggcactggaagttcctctctctctgcacgtgcggcaagagctgaaaaaggagaaagggtcactgagcaggttttctgtgtctgagccccagagttcaatctctgctgaccagacccccactgaccagacccctgagcggtggtgttcagagtcccctaccaatggcccttctcagtccacagacctctccctcccctcatcagcacccacaggtgactgagagtcttctcgggactggaccccaactccaggacacagggaggggcagtttgtcccaggctccgggtgctgagcttcacgcttgtgccacaaggtcctctgggccatctcaaagggggcagtgatgtggcctcgcacatctggatgcactgtctgggcctattcctgagccacatagccagaggaacaggaagctgtttgtcaacccaggcaccccactctgctgggtctcccagggtccttcccatggaggccagatccagagacacagcacagaggcagcagggtgaccggcccagaacccttgagactaggctggggacgacaggaggactgtccccagacaaccagaagaccctttgctagtttcttgatacttcatttctcacctgctacccttactccaccagaaatccccttcatgcagagtcaatgaggagaggaagacggacacagaatctgtggaaagaaagaaaacaaaagatgggtggggagaagagttgggagtgtaacgttgtaagcgtcctacactatgcgtattatttgagggttgattaattaaaggtgtgccttgtagacaaccattacacacactataaataaattttatatatatatacatatatatatatacatatatatatatgtatatatatatatatggagagagagagagagagacagggtcttgctccgtcacccaggctgaagtgcagtggcccaaacacagctcactacagccttgacttcccaggctcaagcaatcctcccacctcagcctccnnaanngctgggantacangtgtgagccaccgcgacttgccagctctgtctagttgagaggtgcagtgcctctcctgtgggccggtgtgctgtgggacctcccgcccctgccgcccctgccgcccctgccgcctgcccgagggctcacccggctgtagtcctccacgtgctggagctgggtctcctggcagatgcacaggttcaggaagttctgccactccatcttcagggcctcctggtgggcctgggtaccgcagcacggagccctcggaccacgccccgcccccgcacccacgtccaccccccccttccccgcccaccacgtcccttctcactctcgccctgcccccagcgcacctggatgggccccaccgcggggtgccgcagctccaccatgcgcttgccgtcctcctccagctggtttacgctctgctcctggctcagcagctcgtgctgcttgaagtgctgggggcgagtcgggtggggagcggcggtgaggaccaggatggccctggtcgcccccgcctggccccaacctctgccagccgacctcgtattcccgccgcacgcccgcagggtcggccatgaggtcgctccagtcctgctgcaggatgcggcgctgctgctccgccagggcgctcagctgccacgtgcagccctgcagtgcgtgtacaggctgcccaggctctgcccgcgccacgacgccgccctctgtgctcaggacccgccgccagcagcagggtggggagagagaaagtggggggcaaaaggcgccattgggcggcgctcaggaacactggccccgggcagggtccgggcggccacccaggcccacctgcagccaccctgcccgaccctccctcctgctcaccagtaggtctcggtattggctccggatggtggcggcatcctgccttgaccaaggggagaaacaagcccgtgagaggtggggcacagggagacggccccctaagatctgggcaagccataccccacccacccctatccccagggcccagccgatctagctccggctctgactggaaaaacaggggctggggctggccccggatgtaacatcttcccggctcacccaccggccccaccaggctccgcagctgctctccttggtcgttgatctccttctgcacgatgttgagctccgcgatctgttcctccagctccgccatgcccggcccatactggcctgcgcagaccagcttctgcaggagagccggcggctcagtcaccacaggaccagggtggagagccagagaaccccacacgtctcccacccggagaagtggacttggtcatttgggcagagcgtggacgagcctgagagcagcccgggtgcacgccctgcagctcacccagggtgagccattctgctctgcagggtggccactgcagaggccattctgcagtggcccctgagtcccactggttcccagacgctgggctcagcctcagaagtctccagctccatcctgccttgtctgtgacccagcctcagtgcttcctgcctggacacctccagccaagctctagggccctcagaacgccctgctgcacccgggcccttccccactgttcctctattgtcatgatgacaccccttctgtgtggcatcaaagcacaactcctcaaccagggatcagaatgccccatgtcctggctctgcccacctggccagaaatccccacttcccatcgaatcctaggcttcctcctggcaggtgcctttgctccttctttctggaattgtcctctcctcactacttcaccctgacccaaccgagccctctcacccctctgaggtctcttcatgtgcctcctcctacaggaagtcttccctgactgcactgtctcctctgctgtctccctgcccagacccctgagacaccactatacactgactgttcaagcctacagtcaggccctgggttaaatgcagttccgtatcaccctctgatcacactggggtgtgactttgagctcctgacctgtttctgctccagcacgtgtgcccagtcgaccttggatcccacgtcggggcggcagcaccatcttctcgtacagggcacagtactccgcacactcctgggtcacccgctcgtgcagctgctcgatgctgtcaagaaggtggccagcaggtcagggctgggcctgggtcttccccagggacccccagccctgccgcagccccactcactccttctcagtctcctcagcctgcgggtgcttgagccgccgggccttgtccacgtccaggaagaggtccttgagcagcacctcggcctccttcaggctgctgcccgtctcctgctggtgctgcagggcctggctctgctcactgttcagccggtcctgtgggcaggggatgggcagacttgccagggtccagagcccccacacccctgctgcccatcattgtgggcctgagccccacctttgggaccccagctatgctggccaacctcgaggcccacgccaggcacagggtcaggcccagggcgtccatgaggcaggtgacaaagacacaggggagcccagcaaagaaggaagttgagccctctctcccaccgtgtgttaggggacaggcggtgcaggacaaatgtcatctgtcccatcttcaccatcaccagggggcactcagggagtgccaggcctgatgatgggcctcccatgccacccagcctgcccacaccctgccaactgctgccgggttctcacctgctgcagcctcttctgcgtctccaggatgtcccgctccacctggtcggcgttggcttgcatgtgggagatgagcagggtcagctcctgggtggcattcttggtgggtggaggggacagtgggcagctcggtggaagaggcccctctgtgccccatccaggtggcgtcccctgccctctctccaccccatcccgcccccacagcctagcacactgccctgactttggggtctctctctgcaggaggctctgtgagctagacctggttgggggtgttagcactgccccgccacatgaggggtcaaaaggtgagggtctcaggtctgtgtggtgctgggtgtcaggcggcctcggtgtcccagcctcagccagctgtgctggcagtgagttcccgaccccacccagctgcctgccacttcccccctgtgagccggtagtacctgagccagcctggctgggccctgggaggggcagttgggctggctggggcagggaggcagcagcatgccccccacccccacctcctcccactccagccctgtgttcccctatacctcctccaccccagggagctttgccagagtgctggcttcagcagccgtctagaggagcctcacactgtcagagtcggggagcgggggcaggcgcaagagactgctgggcaccctaacattctccagagttgagagttcaaagcccagattgtgccctaacttgctctgagttacgtggtcagggacggaggggaaaccttgcttccaccccagggctttttctgtgcattcgccctgcagcctccatagagcacctgctgtgtgcatgcagtcactctgtggaggtcacaaggccaagcagacctaaaagagggcagattggtccaagccttatgagcacagtgccttatgggggatcattatcctggggcaggggaagccttgaactgggtcaaaggatgggcccccccaggcaacgggacagtgctggtgaaggcacagcagtctggaagaactctgtggccaagacagcctggtttcatctttctccatcattaatgctgtgtgaccttgggcaagttactcaacctctctgtgcctgaggttcctcactcgtaaagcaggattttaataaaaatatctatgccttagg

SEQ ID NO: 69878 - DNA, 286 bp, Homo sapiens
gttgatgaagaaaacagaacgaattcagaagaactatgatcttgtcctgtggtttttctctgactttataaagacctaggcttcatatctttgcttctatggagaccagatgcctcatttccaacatgaagggcttgatcagttgatctctgtgttcctttctcagaggtctaatgttctacaattaaatgccagtcaagtcaagagcaggcatctcagattcttcagaataaccaccatgaaaggaaaagaatggagagaagaagaggagtgactgaaggaataa

SEQ ID NO: 69879 - DNA, 461 bp, Homo sapiens
aaatgaatgaatccaatttcccagtgtaagtgatcagcagtgtttgtgaaataggtaatgtctaagaaaagtctttgaaaatcagaaaaagaagcagagtaccctcaagaagaaaaacaagcaaaggtgaagacagaaagatgagaaggttggagagaggtggtagaaaactaatctgattaggctggggaaatttctcaggagagaaagaagttcccaggtcaattacatttagaaacacttcaaacagtctttttggagacttgcagtgctccttagaatattaacctgctatatggaaatcacaattgagtaactcttattttacctgacagttttttttttcaggggacatatatctattatcattggcataagccaataattgatggacctttcgtagagcctttaaatcagggcaatggcacagtcaatattttgtttcaaacatagccatctaa

SEQ ID NO: 69880 - DNA, 421 bp, Homo sapiens
tatgagtggattaaatatatatttattaaaaaaattatccagcatagatcaattagtttaaagtcaattttcttcgcaactagtccttttcacagcttaccagttaccctcgcagccagtgttaaatccactctaggaaatgggactttagagcaccagattaaaaggaaaactattcttttctctaagggcaactaattgtttctttttatttaaacttttcacagccccattaaattgtaaagcatctcctagtctatgaggaacatcaaaaaaaattgtaaagcatcttttgaaaacaaattcaacatactgagttgtaattataaagttttactgcatcatgtttaaaaatgtactttttctatttaaccatgccagttgagatttttttttttaaactaggttaaaaagttgtgta

SEQ ID NO: 69881 - DNA, 748 bp, Homo sapiens
cagggtgtggctttgtcgcccaggctggagagcagtggtgcaatcacagccgggcaccagagcaagactctgtctctaaataaataaatgaaataaaatgccctccaccatctgactctcagttcactctgcgacttcatctccacttctgctcaatcatttggtgctcgtcacgccagcctccttcttgtttcttgaacaccccaagcacgatcctacctcacgcctttgcactggtggccccctctgctttgcctcaggtcccctgagccctccctcacttcatctaaggttctgttcaaatgtcacctcttcagagaggcctcccagaccactctctaggaaactgcagactctccacccgcagacatatacctgaccctcccatcttcccttccgcttgagttttccccaggacacttacgaccacaaatctgtgattatttgatcaattatatgattgatctcctcaactggactaaaagtccttgagctctgagtcgagtctgttctgttcactgttcccagtgcctaggccagagcctggcacacagcaggaactcataaatgcttcttttgtgaatgaatgaatgaatgaatgagtgaatgaccggagtgcgtgggtgactgcactacactctttttttttttcttatactttaacttctggggtacatgtgcactatgtgcaggtttgatacataggtatacatgtgccattttggtttgctgcacccatcaactcgtc

SEQ ID NO: 69882 - DNA, 700 bp, Homo sapiens
gagcactcttagcatgattagagttgttgtttccacacaacaaaagcgtgatgttattcagaaagagcaatcagaaaataaaaaagatgttgaacatttttttaaataactaaaataaaaataatttactagaaggctaataatggaaattcttcctggtccaagtccagtggtgtttacaactaattgatcacaaccagttactgatttctttgttccttcatttccactgcttcacttgactagcctaaaaaaatgatgatgctgatgatgatggcacttctagcaacacagagggcgaagctgactcattcagatctccctccaggacaaacacacaaaaatgaaggataaaacataacaaatgttcaaataaccttgaaataaagactgtcagaagaatgcagagaaaaatgtttaaaaaagaacaataataataagaaatcctacatgcagcccaagccataggaatttttctgtggaatatagaccctagagtgttgaatgatgaagttgtatcattcaaacctggaaagaaaatttggcttcaggcccacaggagaccaggaccatggaattgaaacactggataagcctggagctctaaagacctgtctagtccattaatagagtattaggcaaactctaaccactacttagggaaacaaggaagtcttgtaggccttgagtgaaagttaaa

SEQ ID NO: 69883 - DNA, 1302 bp, Homo sapiens
gaagggcagagaatctatcaactagggaagacgtctttacaaatacagcatttaatacattcttcttgactaacagttctaagccaagtcactgagcatgttcaaatggggcactagtttaattgctttagtttcaaaattgccattttctatttccagttttcttgggttttctgcagtgccactcactatccttttcatctgaactcagagatgcaaaaaatgtgagccaaactgggtctatcccaactgactactgaaaaccaccccctctccttgctctcttgtgagcagagcttccattgttctgagacaatatgacatttcctccaaacaggtagttagtaaataaaccatcaaatactggaaacgatgtttattttaagtttttcaaagtaccaggggaaaaaaagacgagagatttccacttaagaaagtctattagtcctgtccttatttcaaaaatgttcaattccatgtaatcttttggagtatgatacctaaaggaattttcaatgagacttgagacaggtgcatttccagcttttctcaattgcttggtgtgtacatttccaaggaggagcctgtataccaactaattctaactctcaaagtccattgagaacatttctgcatatgaccaaaatgatcaggctaccaaactggccactatgatcattctagctgttctcataagagattaaattcatgaacaaggtgtcagcttgaatgcttctctggccttacttgacctgccacctcccattcataataatggttaacaataacttgtcatgtgtttgtgaaaacactgtgaacttctccatccaataatattcagtatgtttccagtcacatggtcagggtaaagtcatggctatctcgctcctcacagaaatcaagagagtaacagagccttttgaaagtcacacatgctcagtaaatgaggaaacactggggttgacatcagtaccaaagctggggtaggaagggctactacagagaactggatggagagttagaaaggccctgggcctctgccccattttaaatgaacctcagacaagacctccaaatatctgtcctcaagttgcttcatctacaaagaaaagagaaaacttccccttgtctccatggtacaaaattaatctgagaatgaaatggtattttgtgccaggcatggtggttcacacctgtaaatcctaacactttgggacgttgaggctggagaatcacttgggcccagaagttcaagaccaccctgggcaacatggtgagactcctatctctaaaaaaaaaaaa

SEQ ID NO: 69884 - DNA, 638 bp, Homo sapiens
cctgtgtgcccttggcagaggctgacctggagactgctggtgggccagagacatagccctgttgccctgcctgctgccctctgggggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgtctccagccccttgtcactatgagcaaacagtgagcttctaccagcccagcctgtttagcaaacacctgggccctgaagggcgggccagctgtgtcaggtccccatcaggttggagccagagcccagctggaaggaaacaaaggcgtgggagagggaggggctggttggctgcaggttctggctggagcttggcaacctagaggctggaacttccgggtcaaggggcttctccgtgggcctcaggagtgcccttcagtgggaatagaatgggactttttatggccgaaggcctggccggagcaaggggtacacagcacagcagcataggggtggggaagggcaggtcttctctcttcgaggctctgaggagatcagtgatgtggtttcaaatccagg

SEQ ID NO: 69885 - DNA, 389 bp, Homo sapiens
cccagaaagaaataggaaatatttcccggggaataaaacgttcctcgtctttgcttatatgcagtaaaaagctcagaacttggagagcgcagaaggcggggcagagtgtgtgaaaacggcgccctctgctggctctccctggtgtgaacagtggtagatggcaacgctgagatggccgtggcatcccctgctctttggaggcaggtacagttttaagagactctggtcataaaagtcagattcgggcaacacttggccctcgcttgggttcttttacagcactttgggaggccgaggcgggcggatcacgaggtcaggagatcgagaccatcctggctaacatggtgaaaccccgtctctattaagaatacaaaaaaaaaaagtcgacc

SEQ ID NO: 69886 - DNA, 510 bp, Homo sapiens
cccagaaagaaataggaaatatttcccggggaataaaacgttcctcgtctttgcttatatgcagtaaaaagctcagaacttggagagcgcagaaggcggggcagagtgtgtgaaaacggcgccctctgctggctctccctggtgtgaacagtggtagatggcaacgctgagatggccgtggcatcccctgctctttggaggcaggtacagttttaagagactctggtcataaaagtcagattcgggcaacacttggccctcgcttgggttcttttacagcactggtttcaacaggagtgatttgttgcccaacacttggtactctctggagacattttggaggatcacaagtctggaggtgaggttaaaggaagtctgctgttgacttctggtgggtagaggccaaggatactgctaaacatctcacactgcacagcccagtccagcccagcaacaaagcaacattcagcccaggatgtcaacattgtccagattgagaaaaccttgttt

SEQ ID NO: 69887 - DNA, 265 bp, Homo sapiens
ttttttaataataattctgctgtctgctgtgtactagaacccatgcctactgcttggggtataatgtagtaaatgtagtaaaaacaatatccgccgggcgcggtggctcacgcctgtaattccagcactttgggaggccaaggagggcggatcacgaggtcaggagagcgagaccatcctggctaacatggtgaaaccccgtctctactaaaaataccaaaaattagccaggcgtggtgatggacgcctgtagtcccagctactc

SEQ ID NO: 69888 - DNA, 482 bp, Homo sapiens
ctactggagaatatttttaaattatgtcacttaaccatcttttctataaaaattatttagacaaaatagtaattgccctaatattgtcagatattagctttcttacaattttcatcaaactgaaaaaaagtactgcttttcaatatatgtcatcttttgcttatatcattgagttgacaagatagaaatgccaccaagacagaattacatgtagttaggtaaaggaagtcagtttacttataatttagaattgacccaggctaaattataaatttctctttattaatatcatatggattgctttttgaagtacatgacagaatattaaaatgtattaattttagtgggaaaaaagccttgctatggcagtataacatgctatttatgttcaatattaaatttttgaaaattccttaaaatttgaactgaatctgttataggttgcttttacaaaataattaaactgagtgatttcaagtgtt

SEQ ID NO: 69889 - DNA, 398 bp, Homo sapiens
tgaatgacactattgccagccagccctcggggttctccactgctgcagttttgaaacttttctttcccaggttaagaaactaaagttgtaatggagaaagaaatgggagaaagctacatcccagagcagaggtgacctgccagcactctaaagttattctagacctagtacaggctcaagcttaggacatttgtttcttttccacctgacttcaaggagcttgtcaaagcgcagcctaagttaacaggctctgtcaatgtgagtaccagaagccaggccgccacctgcgctgttccagaagccagggatacaatgaaaaaacacaaacgtttctccccattttgctgtatacattccaattctttcgctagggactgtacaaaatcctgtcttctctg

SEQ ID NO: 69890 - DNA, 471 bp, Homo sapiens
tttttttttgtagttttgtctttttttgtttttgtttttcaagtttccaaacaagaatttattctttctttaaaaaaatttttttttctaaaaaaagtaccaggtacaattttttcctgtttctgttttttcaagtttcagcaaatgcttgttcccctcagcccagccccaggagtcaggactgaggctgggtcagagtctggagtgggggatgggatagttgggagccacatgactgagtctgagagttgccccttagcccagatgaagtaggtgggtcagagtctggccaggtgaaaggaggcaccccagtccttggacctgactctgcttcctggacaccttcctcagtcacaccccaaagtaaggagacacaggtaggaggaaagggacaactggagtctggaactgtaggtgaggggtggttaacctctgtgtgtgtgcatacatgcacactctctttctcacaca

SEQ ID NO: 69891 - DNA, 1690 bp, Homo sapiens
tggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgggggaatttgccaccttacagagtttgtatcactgaattagctgcttttgttttttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttattttttttttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaatgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcatgaatggatgcctttatgtgatatagagtcatgtgtgtatgtgtagctttaagggcaatttcagaaatgcattagatgaatgacattttataaagcgatcacaattgatatctacaggctattatgtctcatgttgattcatgatccaggaagttttatgtatttaaaaaattgctatcgtgttatatttttccaatttttggagaagaaaatagctgtttaggctctctagccacaataaatgtaagcaggaaat

SEQ ID NO: 69892 - DNA, 441 bp, Homo sapiens
gaaagactcaattaggctctttttctaccaaatcaaaatgtaagagctagccgctatgttaaaaatgtctttagctggaccactgttagattcagagtttctcaggttttacagatgtgcatatgtattttattatcttctaatcaattactgggatatgctcaaacttaagagacttcatctaaaaagaccacaatttgttgtttgttaaatattatgtataactttctccattaaccaaactttttccagtagctctttttatagaaaaataactcatcagacatagaatgctgaaaaattcgattttccattgatattacatatacactaaggaatagtaacaaactggtcaagttcatttttttttttcctaatgccattgctttggttccactgggaatgtcactgaaatgatgattaatttcttacctgggaact

SEQ ID NO: 69893 - DNA, 1252 bp, Homo sapiens
actgcttttggccaatctccatgagagaaagttctcaacctctgattgcaagtttattttgaccatttaccataacttcaacttcaatgctcgtcttgaagggcatgacttgtcatcctaatataattagcccctcttccagcagatcagacccacaatacgccccagcctctggaggacacagagagaatggaagtcgtggagaagaaaagagaaaagtctcagaggaccaggatataccctcaggactagcactgtgcctgccgtagaacggggcctgctcagtgttttttgggttgagctgcatcttagaatgaaatcctacaactgagatggctaaaggaattaaaaatggtatctgtaatgttaaatttcagactgctgcacaatatgtcagttttaggtactttttaaaagatgaacaagtacaagacttcaaagaagtctctcccttgtgaagggtcccttccggcttcactttagagtctctgcacttttagttcatctcatttgggtgtttcaagggaacagagaagccctggtttagatgatgcagggttttctgatgccaaagtgagaatgataaaatgtctgaaggaagaacacgatgctatgcattccaggcagaatctggacttgaaaacaatgaagcacaaatacttttagatgaactgattcacttttattttgtaaacatcctagaagaattccatttgcactgaactgtttgaatcactgcagagctcttgctccttctaatccccaaggaaagtcgatccatcgcgtcctgctacactgtatttcttcactttgccccttttctcaattctttgtgatcagcataaagtttgaaccgtgcctcttctcgccttcctgcctggccacctgtccagccctgcggtcagctgtaccgaccagcagacggtgcctctcttgccaagtggagccgatgctctgtgaccattgttcgtggggccacactgccatccccatcgttgccccttcaggacactcgtcaacagctgtaagaggcttcccatcctcgcccatataaaaggaaggcctgaaaacacttctcggagcatcagttcataggtcaccgcaaccggccgaacaatacgcgattattcaacgggctccaattcattttcctctgctcctcccccaccgttacccttgagagaaaactaatttgcagaaaaatagcccctgccagccaacttcttctcctaaatgtatgctgaccccgaac

SEQ ID NO: 69894 - DNA, 440 bp, Homo sapiens
ttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagcgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccactgcactccagcccgggagatagtgagagactccatctc

SEQ ID NO: 69895 - DNA, 422 bp, Homo sapiens
gatgactgaaactgctatagccacatttggacccagaagggagctaacctgagggcaaagccagcacattgaagctgtagaggagaaaggaaaaaacctgcccttgcagagctgctgattcttttttagcttttaagttcaggcgcacatgtgcaggtttgttatataggtaaactcatgtcacaggggtttgttatacagattatttcttcacccgggtattaagtctagtacccattagttatttttcctgatcctctccctcccaccttctaccctctggtaggccccagggtctgtttttcccctctatgtgtccatgtgttcttatcatttagctcctacttataagtaagaacatgcagcatttggttttctgttcctgcattaggttcataaggataattatctccagctccatc

SEQ ID NO: 69896 - DNA, 370 bp, Homo sapiens
cataggcaaataataattttatattcagaatgtgaacagaattacaatgacaaattaggaaatacagttgcactgcaaagtaaaaagatgctatgaaggaaaagttgggattcagcaagtagtgtcagccaatgaaccatcagcattcaagactggctctataaagcagaatccatggcaaataaaacttaaattttctttaaatttacaaaggaaaaccaaaactatgtgtacctgatacagttagttaatttactttctcaaattgtaatgtagaatcaacttggtcatttatgttcccagctattgtgatgtataaccctataggtatagtatatataaatgcagcaacaacattttatcattgagc

SEQ ID NO: 69897 - DNA, 4084 bp, Homo sapiens
cagtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaaatctacattttgaccatactaccctttcatgttcttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagatgcttgagccttgagatggaggctgcagtgagctatgccactgtactctagcctgttcaactgagcagaaccctgtctgtaaaagaaaatcaaaaacaaaaaataaatgttaaattttgttttaagttttagcacagactcccctcaaaacaccttctccccaattttacagaaagtaatttaaaaatgaaaactttactctgtaaagacctctacagtgtttttcttttcaaatttggctgattttaggaaaaaagtgatcatctgaaactaaaagaaattgcttggttagtttccatattaaaacagcagtgacaagtatatataacttagatctcagcatatgtgtttgtatattaaacttcacatatgtagttttcagtttaatggaatgaatcaaactggatctataacactgaaaaagttctattgtaatagactcatacggagaatactctgctataataatataaaattaagaagaaaaagtataaacgtaagatgctaaattccataaatgcatatttagtactatgttttgtgggaaaagttctaaaagtttaaaatgcacaaagaaaatgaaaaatactaatataaaaatttgtgctttaatctagtcaaactaaatcctttcta

SEQ ID NO: 69898 - DNA, 1505 bp, Homo sapiens
cagtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataattaatgtctagactggggttggtgcctcacgcctgtaatcccaccactttggggggctgatgcaggagttcaagaccagcgtgggcaacataaggagacttcatccctacctggggaaggaaaaaaaaaaaagaaggaagaagcagtgtctaaagtatctgcccctggcaacgtttgttcaaaagtgttcattatgtttcttccttttttcttttgtggctgaaaatgtatttacaattcaccgtaaatgataaaaatggcattggcacacatatt

SEQ ID NO: 69899 - DNA, 1865 bp, Homo sapiens
ccggaattcccgggtcgactacagcgaataaaatcgcggccgagtcgacaccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaaatctacattttgaccatactaccctttcatgttcttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagatgcttgagccttgagatggaggctgcagtgagctatgccactgtactctagcctgttcaactgagcagaaccctgtctgtaaaagaaaatcaaaaacaaaaaataaatgttaaattttgttttaagttttagcacagactcccctcaaaacaccttctccccaattttacagaaagtaatttaaaaatgaaaactttactctgtaaagacctctacagtgtttttcttttcaaatttggctgattttaggaaaaaagtgatcatctgaaactaaaagaaattgcttggttagtttccatattaaaacagcagtgacaagtatatataacttagatctcagcatatgtgtttgtatattaaacttcacatatgtagttttcagtttaatggaatgaatcaaactggatctataacactgaaaaagttctattgtaatagactcatacggagaatactctgctataataatataaaattaagaagaaaaagtataaacgtaagatgctaaattccataaatgcatatttagtactatgttttgtgggaaaagttctaaaagtttaaaatgcacaaagaaaatgaaaaatactaatataaaaatttgtgctttaatctagtcaaactaaatcctttcta

SEQ ID NO: 69900 - DNA, 1346 bp, Homo sapiens
cagtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagaataaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaagaaaaacttctttgaagaga

SEQ ID NO: 69901 - DNA, 3544 bp, Homo sapiens
cagtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatctcaacatctgctgcaatttgactgttcagatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaaatctacattttgaccatactaccctttcatgttcttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaa

SEQ ID NO: 69902 - DNA, 1258 bp, Homo sapiens
cagtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaagaaaaacttctttgaagaga

SEQ ID NO: 69903 - DNA, 5024 bp, Homo sapiens
ggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacttgctgttgaaagagtccaagtggacgaagatgttctttggagaaggccaggcctccctgtccttcagccacctgcacaaggacgacgagggcctgtacaccctgcgcatcgtgtctcggggcggcgtcacggaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtcggtggtggggagcggcacgtggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcgatcagacgacaacagccagccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacagggcaacatctatctgggcttcgactgccaggaaatgacagacgcgtctcagttcacctggtgtaaatcctacgaggagatttcagatgatgagaggtttaaaatcgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgctctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatcaaaaaaaagttgtgg

SEQ ID NO: 69904 - DNA, 1781 bp, Homo sapiens
agagatggtaactccagcagggcagtttcatatccaccgagagaaggagatttaggatacacatccagcagttaaaaccagcaggggctggcaagtagctgggtgtgggtgagagggaagtgtactggaggaccgagtgggtgtgatatttcttgagatcagcactgtacggggagggccaagttttagggttttgagaatacattcaatttcacaaagatttagttatatccgtggaatggtcagtaaggcataaccggctcacgacaggacatgtgaacctggcagcaatgggaaagtcatctggagcatgtggattcatgagatatcgtgtgtggattcatgaggttgcaaacaccaagaaagaaaccgttttcaaatggctcaaggatgatgctctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatcaaaaaaaagttgtgg

SEQ ID NO: 69905 - DNA, 4610 bp, Homo sapiens
ggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacttgctgttgaaagagtccaagtggacgaagatgttctttggagaaggccaggcctccctgtccttcagccacctgcacaaggacgacgagggcctgtacaccctgcgcatcgtgtctcggggcggcgtcacggaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtcggtggtggggagcggcacgtggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcgatcagacgacaacagccagccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacagggcaacatctatctgggcttcgactgccaggaaatgacagacgcgtctcagttcacctggtgtaaatcctacgaggagatttcagatgatgagaggtttaaaatcgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgctctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagttttccagctttattctttttgtttgagaagcagcaatgttccttccagctttctgcaccctgggtagaagccggaagctccccaagcagcagactcgcatgcccataggtgatgtctgtgacgcgccacatccaaacgaagagatatcgttggaagacttgaatctagctggaaggccaatgttcttttcaatgtaatgccaaagaaaattcacacttgtttgttctgtagaaaaaagtgacataatattatttttatttttaaatttacttatagtcatatgtgcatgcctgctcaaaaatgctcacccatcatttgcataagtaaatcagtttgtatttaatgttacagtttaagactcatgtttcagaaatacaatttttattaactga

SEQ ID NO: 69906 - DNA, 388 bp, Homo sapiens
tatggataaatattgccattttaatgattcatttttcaactgaacatcacaatttcctgcatcgatttaattaaacattgaaaatgctgctttcggttaaagttacatgtcgtaatggtgcgtatcccttctcattttcagtgtatgatgatatgattttggcaatgagtagagtctgtggtaagtaaatgccttttaattttcaagtcatttggggtgctgaaatcactatttcctgacacgggaagtcactgctgcaaaagagggcaccatggagctgtggtgcgtgttctgtgggaggccctggatggaagggcagggtggtgatctgctgccgatgaagctttttaaaggacttccctcagttttgtctggagtttgagtttta

SEQ ID NO: 69907 - DNA, 929 bp, Homo sapiens
catggctcctgctccgtgggaacgtcccgcagatgttttcctaaccaaggtgctttcccgttgcagatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatcaaaaaaaagttgtgg

SEQ ID NO: 69908 - DNA, 1345 bp, Homo sapiens
aggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatcaaaaaaaagttgtgg

SEQ ID NO: 69909 - DNA, 413 bp, Homo sapiens
tgaaattacagccttgggtagctgcttacttgggaggctgggaacagcccggccctgtgcatcacatactaaagctgcatttacagtcccaagagcaaagggacagatcacaaatcagatcatttattgctgctgctagctcagcgaggataacattcccaaggggagagaggtggaggctctggccgtgagtgtaacagtttggtcccagggctcctgaggatcatactgggcaatgctagcgatattggctgaggagagcagtaaacgatgacccacagaagcttgctctctcttctctctctgtgttgtatctctctatattttgctcatccatcaatctatgtgtgagatggggaggctctctgaccaatagtcttcaaaaataaaatgcaatttgccaaacaaacaaa

SEQ ID NO: 69910 - DNA, 441 bp, Homo sapiens
gttctgaaacccctcaagcaccaatgagtggcgtaggtcctgtgagtggtggtcctggtggctttggtagaggaagtcaagggggcaactttgaaggccctaataagcgtcgtagatattaaacattcgttcattcctggctatccagaaaaaaaaagtcagtggtatgcctttatacttttacctgttatctggaagaaatggttttattgttaatgtatgtagacttaaaagttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttacttaatctcaataaagaaatcattttggataatttaaaacggttatta

SEQ ID NO: 69911 - DNA, 1828 bp, Homo sapiens
gctaccatgaagcgccttctgcttctgtttttgttctttataacattttcttctgcatttcccttagtccggatgatggaaaatgaagaaaatgtgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggaacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaagggttcccgcagagagtggtaaaacactttcctggaatcagtatccgtgttgatgctgctttccagtacaaaggattcttctttttcagccgtggatcaaagcaatttgaatacgacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaacaagttgctggtcctagttctaaatatccaaattcaatggccattttgagctgcctgattcttttaataggaagttattatgtagaaacaaaaatctctgactgtactttaagcctatttcatgctttgtggacttggagaagacatgtcttataactgaatactgaaacatttattaaaccaatctttagcattctat

SEQ ID NO: 69912 - DNA, 1630 bp, Homo sapiens
gctaccatgaagcgccttctgcttctgtttttgttctttataacattttcttctgcatttcccttagtccggatgatggaaaatgaagaaaatgtgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggaacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaagggttcccgcagagagtggtaaaacactttcctggaatcagtatccgtgttgatgctgctttccagtacaaaggattcttctttttcagccgtggatcaaagcaatttgaatacgacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaac

SEQ ID NO: 69913 - DNA, 341 bp, Homo sapiens
ctgtggttcacatgaatacaccccggcaactctcagctgccagagctggaatctggcaacttccctggacgggaaaggctagcccaccgcccgggaagtgaggtgcgggcaacaaaagaacacagggtggggcccagaaacggacgggacaaatggagcaacacagattttccagaaggcctcatcagcgcaacagccagcaacaggttgcccttgttgcagaagtcacataacctaatcaactctgaatcttttctctcctccccactatctagaaacagctcaggacttaggactctgttaacttctctgtccacaagaaaaacttctctgtgctcaca

SEQ ID NO: 69914 - DNA, 2273 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgccacatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggta

SEQ ID NO: 69915 - DNA, 849 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaaaaagacaacacaaaacaaccacaaagacacacaagaaaaaaaagaaaaaacacaaagaccaccagcgagcaggcaaccagaaaaaaatacaccaaaccgccacagcacagaaaa

SEQ ID NO: 69916 - DNA, 686 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatcataaa

SEQ ID NO: 69917 - DNA, 313 bp, Homo sapiens
gcggccgcctactactactactactgctcgaattcaagcttctaacgatgtacggggacatgtattttcttttatctttggaacatcagcaccagtatattgctggcagctattgtattaaaaaataaagtatattttcactatcataaaggattcttttttcccccctcatgaaaataaacaacaacttggggtaaaaaaagacaacacaaaacaaccacaaagacacacaagaaaaaaaagaaaaaacacaaagaccaccagcgagcaggcaaccagaaaaaaatacaccaaaccgccacagcacagaaaa

SEQ ID NO: 69918 - DNA, 2227 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgccacatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaa

SEQ ID NO: 69919 - DNA, 1181 bp, Homo sapiens
gacccacgcgtcgtcgacccacgcgtccgaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaa

SEQ ID NO: 69920 - DNA, 2390 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgccacatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaaaaagacaacacaaaacaaccacaaagacacacaagaaaaaaaagaaaaaacacaaagaccaccagcgagcaggcaaccagaaaaaaatacaccaaaccgccacagcacagaaaa

SEQ ID NO: 69921 - DNA, 2574 bp, Homo sapiens
tcaccccatttaccttgtatagaggattgttcattctttggggactaagttatagttatggtgagtgtgtatttactgtagttttgcctgatctcactcattgcacttcctggagttaaattttccacagcccatgttgaggaatagcactctgcaggtttttgtttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgccacatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaaaacaaccaaacaaaaaaaaaaaaagaaaaaaaaaaaaaaaaaaaaaaaaattaaaagaaaatagaaaagaaaaaaagaaaaaaaaaagagaaaaagaaaagaaaaaaaaaatagcaggaggagcaagaacggaaaaagcaaccaaacaaacgaaagagaaacaaaaagaagcaagagaacaagaacaagcagaaatgaacaacacgaagcaaaccagaagaagaaaaaaaaaggaagaaaaaagaaaaaagcgaagagaaagagaaaagcaagaagcgaacaaggagcaaaaaaaatggagggaaaatcaagaccacatgcccaaagcaacagcacaagaaaaaag

SEQ ID NO: 69922 - DNA, 598 bp, Homo sapiens
gatagtgaaaatatactttattttttaatacaatagctgccagcaatatactggtgctgatgttccaaagataaaagaaaatacatgcattctataataagctttcatttgcctgttcaagaaattataaagaaaatactccaattctgttcaacattacggcttgaggagttgaaattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggta

SEQ ID NO: 69923 - DNA, 275 bp, Homo sapiens
cagatacacagaggtgccgggaggagaagggacgcattggcccaccgcctcgtgagtccaggcgccgtaattggtgcttcacgcatgtcgtctcagtaatcttcataacagccttgcaagggataagaaaacagaggcccagaaagggtaagtcatttgcttgaggttacataactggcaagatgtcaggaatgaatataaaccagcatcgattgagcacctactattcggcaggatctgtgctgtgattcttatccttgtgcaaaccctcagag

SEQ ID NO: 69924 - DNA, 964 bp, Homo sapiens
gtcagggacccaattgaggaggcagtctgtctgttctcagagcttgaacgccatgctatgagaaccactgctctcttcagtgctgtcagacagggacatttaagtctgcagaagttgtctgctgccttttgtttagctaagccctgcccacagaggttgagtctatagaggcagtaggccttgctgagctggggtgggctccactcagttcaagcttaccagctgctttgtttacctactcaagcctcagcaatggcggacacctgtatgcccgccaggctgcagcctcgcaggtggatctcagactgctgcgctagcagtgagcaaggctccatgggcgtgggatccaccaagccaggcacaggagagaatctcctggtctgccggttgctaagatggtgaggaaagtgcagtatttgggcggaagtgtaccgtttttccaaggatagtctgtcatggctttccttggctaggaaagggaaatcccctgaccccttgtgcttcctgggtgaggtgacataccgccctgcttcggcttcgccctccatgggctgcacccactgtccaaccagttccagtgggatgaaccagatacctcagttggaaatgctgaaatcacctgtcttctgcatcgatctcgctgggagctgcagacgagctgttcctattcggccatctgggaggaccaagaccatgtttaattttataagaaactgccaaactgttttgcaaagtagctgtaccgttttgtattctcaccagaagtgtatgagaatttcagttgtgctgcatcttccttacactctgtgttgtctgtttatatgattttaaacatttttatgtgtgtggtagtatctcattttggttttcattttcatatcactggccatgaatttgaatatcttttaatatgcttatttgccattcatatgtcttctttaataaactgtcttttgaaatcttt

SEQ ID NO: 69925 - DNA, 873 bp, Homo sapiens
cttccgacctcaagtgatccacccgcctcgacttcccaaagtgttgggattacaggtgtgagccaccacaccactgagtcttacagagagaataaacttgagccctttattatgtgctgtcctaacaaatctcaggtatcagaacagcacttatcagtccagaactgggtaaaaagggtctattaaaatgaaggtccaatgattctgggctaaattcagtcttagacatcagaatctgagggctatccttgctaaagaaacaaccaagcagcagcacttacattccaaggatggttttgtactcttagtaaacctccacggggttcaccatcctgagccaaggacccaaatgcacttttagtgatcagaaagaaaacaaaaaacaaaaaacccagccaacaattagaggcatgagggcaattttaaatgcttatcccatatttctgccaatttcagcatttttatttgtgtggatagcagcaacccacagaatagtagcaagcaactacgatattatagttattaggtcataacaagcaaactgcagaagtggccagattactccgatgtacctcaaagtaacagtgtgctataaatgctcagtttactgaggctaaagatggaactaattttctcttaagatcagtggtactaaataatacagcaaagctattcacacccctcaatcataaatctattttcaagaaaacccatgcctgcaggctaacaatgattaaaatatgaagaaaaaatgcactttataccagaattattaaaaattttcctttaaaatgagactgaaactcaacttgtttttcctcccaatacactggaaaacattatgcctacactctaaagtaaccatataatgct

SEQ ID NO: 69926 - DNA, 223 bp, Homo sapiens
ggcagaggttgcagtaagccaagatcaggccgttgcactccagcctgggtgacagagcaagactccatctcaaagcaacaacaataataataataataataataggtggaatgagaatatggctccatcctctaggatacaaaagtgcttctcccatagttgagaaaaatagtaactatttttaccaaaaacacctgtttcagaagcctcttaacaccacaat

SEQ ID NO: 69927 - DNA, 351 bp, Homo sapiens
attttatccattttggcaaatgctttgccattatatcttcagttgttgcttttggcccattgtctctctcccgcttcccctcttagttctattacacatatgcagttttcctaagactcatccatctttggtccttccctgtttctcaaggaagacccttcaaggatttgggctgagagactagtgggtcactctccctcaaacatggaagactgtggcaaatccactatctagatttgagcttggatctttagctcccatatcctgcagctttaaatgtggcaaacatcttggaggactagttggtaggcccagtccctctggggaaatacagtctctcaagcacttgga

SEQ ID NO: 69928 - DNA, 741 bp, Homo sapiens
  misc_feature (489)..(489): n is a, c, g, or t
  misc_feature (492)..(492): n is a, c, g, or t
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagacttaaaaaaaaaaaaaaaaaaacaaaaaaaaaacttgtgtggcggcggcacnggncccaaagaaagtgttttcacaaccactccgcggtgggggggcgcgccggcccaagataggtgattggacctggggccagagggcgtgcaccaaaggagagaaccggcggcccagagactgggcgggggttccccaccaaagaaaaaacgcgccgggcgaccccggggtgtctgagcaaatccaaggggcgctcgagggcagcagggctcaccagagggccaggagccataaatcgcgcccggagggggg

SEQ ID NO: 69929 - DNA, 460 bp, Homo sapiens
  misc_feature (10)..(10): n is a, c, g, or t
  misc_feature (25)..(25): n is a, c, g, or t
  misc_feature (35)..(35): n is a, c, g, or t
  misc_feature (39)..(39): n is a, c, g, or t
agcaggccancatactactactaanttcgcggccngtcngacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagactattctggctctgggcacctcattt

SEQ ID NO: 69930 - DNA, 436 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69931 - DNA, 785 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagactctaaaaaaaaaaaaaaaaaaaaaaaaaaaaaaaaaaaaaaaaaaaaaaaaaaagaaaaagaaaaaaacaaagagggggggggcgagagagaaaatacctcgcacagggggagcgacaaaaacagagcggcacacagccagctcgtgagaggaaagggggcgccaaataagaagagggccgccattaataaaaaaagcaaggagcagcagcgcccgaccgaagaaacaaaaccgcgtccagcgcgcgaagaaacgacccacagcggcagcagagctatcggaaagagaggcgcccacaaccaggaggggggcagcaacagcagacccacaccccgcacaaaagtcag

SEQ ID NO: 69932 - DNA, 463 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagactattctggctctgggcacctcattt

SEQ ID NO: 69933 - DNA, 467 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttgttttttttttttttttttttttttttttttttttttttttttttttttttttttttttttttttttttttttttggggggggattttttttattaggggg

SEQ ID NO: 69934 - DNA, 1759 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctggtaagggacacctagctccgcgccttgggatgcccgtttcccagccacagtacagactcttcctgggtttgaagaagtcgcatttaaagttctgagctgaaggggctcctttatttcgttaggtgctttcttcccgatcacgtccctgagaccacttctcgcctccctgtgcctctaagttagagttgagggtactgaggcccaaggctgtcctgctccatgtcacccagttggtcagggggctgctggctgagccccaatgctctgaccaggctctgagcagtcagggtggatgggaagtggggggccattgcctcttcggagttcaggacagaaggttctggcctcctgtcttagccttcctgggctgtgtctggagcctgggaccttgcttgtggggtaaaagcaacagaacacttgcccttcccaaaatgaagggagaggagatggggcttctcttcctctcccctgagtgggaaaggagctctgggggctggtccttcagcacagaggaggggtcactgaagcgttattgaccagctgctgtaccttctgcatctcactccacgctcactgcctttttctcttccttgcagttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccggctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69935 - DNA, 1113 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccggctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69936 - DNA, 1184 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctggtaagggacacctagctccgcgccttgggatgcccgtttcccagccacagtacagactcttcctgggtttgaagaagtcgcatttaaagttctgagctgaaggggctcctttatttcgttaggtgctttcttcccgatcacgtccctgagaccacttctcgcctccctgtgcctctaagttagagttgagggtactgaggcccaaggctgtcctgctccatgtcacccagttggtcagggggctgctggctgagccccaatgctctgaccaggctctgagcagtcagggtggatgggaagtggggggccattgcctcttcggagttcaggacagaaggttctggcctcctgtcttagccttcctgggctgtgtctggagcctgggaccttgcttgtggggtaaaagcaacagaacacttgcccttcccaaaatgaagggagaggagatggggcttctcttcctctcccctgagtgggaaaggagctctgggggctggtccttcagcacagaggaggggtcactgaagcgttattgaccagctgctgtaccttctgcatctcactccacgctcactgcctttttctcttccttgcagttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69937 - DNA, 439 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69938 - DNA, 464 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttgttttttttttttttttttttttttttttttttttttttttttttttttttttttttttttttttttttttttttggggggggattttttttattaggggg

SEQ ID NO: 69939 - DNA, 987 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagactctaaaaaaaaaaaaaaaaaaaaaaaaaaaaaaaaaaaaaaaaaaaaaaaaaaaaaaaaaaaaaaaaagggaggggcggcgcggcgcaaaaaaatatatcccacccgagggggcgccaccacaattaacaccgcgaccacaccagttttgttgcaaaaaagcgggccgccccacaaaagggagcgagcgacataataaaataacaacagcgaggcagcggggccgacccgcgtattaaacacacaccacgctgcgtatgatgtgggagcaaaaaacaaacgctgtccgacgggggaacccattactgggtggagaagaaagacaacccacccacacgtcggggtgcgatcgagcacaaacacatggttgagcaacacaaccccacaccaacgcgaagtaattatcagccgccccgacggcgaccaataaatacaatatgagcatggagtgttaattgggtgtgccaacaacacagcacatatttaatgttggttgcatagaaagatatttcgtccgctcgtaagatatcttgtcacaacattttttacg

SEQ ID NO: 69940 - DNA, 549 bp, Homo sapiens
ccggactataaagagagccgccggcttctgggctcgaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagacttatttagctgttccaaacacagaagctttattgatgcaagtgagggagtcctgatccaaggctgtgtcctgctaggattccccctcctcctgtttcctctccttctcggg

SEQ ID NO: 69941 - DNA, 1163 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccggctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggtacaaccctgacccgtttgctacatctttttttctatgaaatatgtgaatggcaataaattcatctagact

SEQ ID NO: 69942 - DNA, 893 bp, Homo sapiens
aagcagtcgtatcaacgcagagtgtccattacggccggggacttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattccccccccccccggccccccctgacccgcccgcacctctccccctctcaccctctgcccctgccccacctcccctcaccccccccccccccccccccccccccccccccccccccccccccccccccccacaaccccccacacccacccccccccccccccccctccccccccccccccccacccacaacccccctcctcccaccccacccctcccccccacccccccctaccctcaccccacccccacaccgacccacaccacacacaacctcacaccacccaaacaacaacatcactacctctccacactctcaacaccaacaccacacacacctcactcacacaacaacaaccagcacccaccacaccacaaacaccccaacccacccactc

SEQ ID NO: 69943 - DNA, 491 bp, Homo sapiens
tcataggctacaggttacccaagaaaaactattaccagtaaatccataaaaaaggatctgtgctacccttacaagttgagcagtatagtcagtcggatcctacttcgccagtttaaaaagccgtagggacaggaagaggcagtgtggtgtgttggtgaagggcctggacactgaggccgggctgtctagttgaagtcctggccccattgctcaccagttttgaccttgagcaagttctttaactctgtgcctcaagtaagtgagagtaataatagtagcccaccttatggcattgtagagaggattaaatgagttcatacacataaagcacttagaaccatgcttgcctggcagttgtatgtccagtgaatgttagttatcattaatggttttatattaattgtaacaatctagagttacccatcgggtaacttaaatgcttgttaaataaatttgaagttttaaagacttgcgtcccatcattagaccat

SEQ ID NO: 69944 - DNA, 172 bp, Homo sapiens
gaagacgtttctaaaattgaaaagtttgaaacaataaaggaaaagggattgagaatgaggctgcagtggaggaaaggaggaagggtggtactacttggacctttttttgcaaacacagggagattggaaagtcctttttgaggttggcaatagtctactcctctcccccctc

SEQ ID NO: 69945 - DNA, 191 bp, Homo sapiens
aggcatggaaggaacataactcaaattaatagcagctatgtatggaaaacccatagctaacattgtactgaatgagaaaaagttgaaagcatttcctgtaagaactaaaacaagatgatgatgcccacttttaccactcctagtcaacataatactggaagtcctagccagagcagtcaagcaacagaaag

SEQ ID NO: 69946 - DNA, 2472 bp, Homo sapiens
  misc_feature (782)..(782): n is a, c, g, or t
  misc_feature (1071)..(1071): n is a, c, g, or t
  misc_feature (1659)..(1659): n is a, c, g, or t
gtagatacgcatgtgagcgctggtgggagacgccaggctgggatttccgctcgatctgggaatgagcaatgcaacctaatgacacccggagctcctgaatcacctggggaagatgaagagagacactctctggtgggaacgtctcctagaaacaaggcctaagatggggcgaccacagccccacagctgtgtccagatgcagggagcactcgcctgtgctgtgagggacggccggtgtcatcgttggagcttcctaagactcccagaggctgatgcacctcccagacccgcctccgcccggctccctgggccctgctccaggggcttcattgctccctgccccgggtcacccctcggctcaccgtctctcaggtgtggaatatcctgctccaatcaaagccatgtcacctgcgttgtccagtgaaacgtcagcggacaggcgctgcccgggctccagggagctcctcactgaggctcactccctgtgcctctgccatcagcacagggggacatgcctggctgcctgtgggaccagggaggacgcgcggtgcgggagcagagccagccacactgccgctgctgcactgttcatctgagtggcgcaagaacttgtcagtgcctttaatctgagggatgagtcttcaggagagtttgttgtcaggatttaacacttactcttggaaaagcagtaatgtgtgctggaaatgaaccgggcagaccctgctcccatctccatctgcctcaatctcagtgccctccactccccaccagcagcgcctgtnaccaagtcactgcacaacaaccacaaatggagagtggaggagcatcactttccaccccgggatcatgacgagggctctgtaacttcaacaaatgcgcagaagacgcctggcctcgagcttgtgcagcacctccggagcctgccttcccttgtcacccacggcaccatgactttggagggtctcagctcagtcctccctccagaggggctgtcagtgctgggcagaaaatcacccttcaacgaccgggcccagctgcgctctgtcagagagcagagaaagcaggcctccnggaggttctcactccaccaaggagacgtctccacccagcgctcatcctgagcaagggcactgggaggaagaaatgcaattttaaaacctgtgctgcgaatgatgacttctgctgcttccgtctctggagagctctgggcacttaacatccttccacccacatgcccgagtctgtgcagaaacctcacccacgcggaggagactgcatttcccagtagcagattcaagtcctgaacttcctgtaccacaaagtgttacccacactggtgggtgccagcctgagactcaactatcaggaaaaacatgaagaattcagtccatgccctcaaatgcacccatgtggctcccaaacggcaaatctcagcaatgagattctcagctaggaaagtccacactgaactcatgcagaggacaaagtacataggcctggggttcttggcacctgagatctctgagcagttttctgaattttcctatttcctgttgaagacataggaacacgtggcacagaggcacagagacctggaaaccaacaggtgacctcagggaggtttgtgaagcaccctgatgagaagacagttgggcagangtggctggctattccccaagtccattttccctcctgggaccagagctgactccatttctcaatctgccttgcagtgagcatagtcagcttcctggcactgctggacctgtcttgaaggctcttttggccggaaatggatgggcagggatctgagagcacctgctatcgggtgagtcctgctttactcatgtcagagatttagactaaaacaaacacaaaatgcaacaaagacctaagtgtaagagctaaaagtataaaactcttataaaaaaagtaagtgtaaattttcatggtcttggattaggtagcactctcttagatgtgctatcagaagcacatacaaccacaggaaaaaaaatacataaattgaatttcatcaaaatttaaaacttttgtgcattaaagttcatgatcaaaaaagcgagaagaaaacccagagaatgagtgaaatatttgcaaatcatacatctgggacaagtatccagaatatataaaaattcttagaactcaacaatataaagaaaaataaccaaattaaacagtaggcaaaggattcgaagagacctttgtccaaagaagatacacaaatgaccaatgagtacgtgaaaagatactcagcagctactcattatggaagtaccactttccactcatgctgagggctataataaaaaacaaaacagaaatgacaagtgcagtgaagatgtggagaaactggatttctcatagattgctggtgggaaagtaacatggtgcaaccaatgtagaaacagtttggcagttccttaaaaaattaaacagagctaccatctg

SEQ ID NO: 69947 - DNA, 1192 bp, Homo sapiens
aacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgcccacagagacctcccagggagagtgagagttatacttggactgacttcatcggtcagaaagccttcccctaacagcagcattatttctgctattaaccccatacatctctggataaagaaactgaaaacgtggcctttggaagaatcaacagtaatgttctgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggatt

SEQ ID NO: 69948 - DNA, 294 bp, Homo sapiens
ggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacag

SEQ ID NO: 69949 - DNA, 404 bp, Homo sapiens
agaaacttccagggtaaaaaagacaggtgactggcttactctctttgcaaacattacaatatgaactacaggaaaataaactgatattaactaagccctctatgggatcctttgagcaggatgtttatagtaaaccagcagttctcaaagaaagtactttgagaccagcagcatctgagttacctgcaaatttgttagaaatgcaaaacccaagactcactggatcataaactggaggtggggtctagcaaaccctgtttaacaagccctccacgtaatactagtgcaacttcaagtctgagaacgactacagtaaacactctatagatttatgaggcatgactccctgaagaatgtcacacaaaaccatgaggtataaaataaagatgttaggctgggcgcag

SEQ ID NO: 69950 - DNA, 580 bp, Homo sapiens
gacaagtccaagaagcaaaatcctactcatttgtttgtaactttcagttaaaagaaaaaattaaggtaaaagttacctgagtgtggtttccaccgtgatggtaggctaccaattttaatccgacctacgtttaaaacactttacagcgtcagcagagcaaagtgtttccagaacactccaatttttaattagtctccatggccaaggaggtagtatctacatacttctagttaattttagttaaataagggatttaaaagcatttgattttgcaactgagacaaaatatgaaggcaaagtgcaagcttattataaaatgaaaataatattataaaacaaaaccttccaggtgttggattgtctagcaagttctaccgtgggtgctggcccctggcattggttcccctccacagggccaagggcatagctgggtgcagagaccggcagtgccgtggtctctggagtctgaggacataagttaaacaagctagtcaagccccagatgcttgggaggcagaggcaggaggattccttgagcccatcacaccaaaccctaccacaccaccccccagctcacccg

SEQ ID NO: 69951 - DNA, 507 bp, Homo sapiens
caaagtagctacagagaaacatacatgcagaaatccaattgccaagaaatcttttgcatctgaatcacttgggactctgtgtgcctgatcatactacaaacttctgaagttattctacaagcctcaaaatgctaatcagactttgttacacacgcttgtgtcttctaaaactaaattggtgatttcaagttggtatgcatttgctaaaacataaaaatcttcttaagctcccatatttatttgtaacaaatatattcttactgtctgtgatatggtttggctgtgtctccacccaaatctcatcttgaattgtagtttccataatccccacatgttgtgggtgggacccgacccggtgggaagtaactgaattatgggggcagttacccccatgctgctgttattgtgatagtgagttctcacgagatctaatggttttataaggggcttttcccccttttgctcagtacttctccttgatgacaccatgtgaagaaggacatgttt

SEQ ID NO: 69952 - DNA, 367 bp, Homo sapiens
acactcctgacctcaggcaatcctcccacctcagcctcccaaggtgctgggattacaggcatgagccactgcgcccagcctacacacactcttaatagaagaaatgaataatcaaaaaatattattgttggaaaaaatgtttgaatcttattttaaaaataattaacgatttcaataggcatgttgaaccttttttcggctattgttttcagcaattgcagttgaatgagtacaaaatgcaccacagaatagagactgctatctacccaaatattgctggttgttgaatccatggtaggaaattttcatgtattgttacaaccagctataaatacatcccaaaatatgtgtagagctaaaatagatg

SEQ ID NO: 69953 - DNA, 364 bp, Homo sapiens
atggagtcttgccctgttgtccaggctggaatgcagtagcacaatcttggctcaccacaacgttcacctctggggttcaagtgatttccatgcgtcagcctcctgagtggctgggactccaggcatgcgctaccacacgtggctaattttttgtatttttctttttttttttagtagagatggggtttcaccatgctggccaggctggtctcgaactcttgacctcaagtgatccactgcctcagcctcccaaagtgctgggattatagacattcatgatgaattcttattttatgtttaatataaagcaaatacaattattgttagataacaatgcacaaaataaaattcaagggtgaaaaat

SEQ ID NO: 69954 - DNA, 387 bp, Homo sapiens
gttataggtatcactttgaatacagaacttaaatgtttcttttcctgtctcttgtactagtctggtttgttctcacagagcaaagccaggattatgtatcatcgcatgggcatcatttagtatgatgactggcataagtgaggctttcagtacagcatgtcaaattgagctgaatgagcacagctgaaaccaaaaagttaacctacaatgtgaaaatctaattaaccacaagaccattctaggagcattctaattacttgatattttattgcaaatctatcttatcaattagtaaaagatcactggttctcagacttttttatttcatgaactggtaaaatttccaaggaatttttaggaactgacataagcttatcaactttttaa

SEQ ID NO: 69955 - DNA, 575 bp, Homo sapiens
tattttgcagtctggtatattaccatgaaatgaaaagaactgtgcatttctgacctatttcaccatcttctggaaatgattttgcagacttgtaaggagactgagtaaaggaagaggaagaaagcaggcatgagtgttgaagttcggtttgactcatgtcatgtgttctttacgttccttttgaatatattaaatccagtgtggaatagctgccttaggaccttgacccacacttactttaagaaatcgttctagttcttaaatttcaatggtaaagccagaggctggtgcttgaaaagtatttacagtgctcaggcagcactttctgcagttacagattctttactgcccctttttatgtctgaactttacatactggattactcgtgtcaataggagaaggaacagtgccttgatttaacacgtccttgtaatagtcgtggtccttctcttctgggaaaggagaagaaatagtgcccctggagtcccattgccttgggaggcatatggctcgtttcagtgattccttgagaattctggtaagaagtcaaaaataagcatttaaataaaaagaa

SEQ ID NO: 69956 - DNA, 252 bp, Homo sapiens
ggcaaaactttaagggtagaacatgaactggagcccagtcttggagttctgttgaacacctctaaatggactatgagtacattagggttatttattcttaaggggtttaggggttctccttgccggagacctattactgtaatagtagaaaagaatttattaattttgtattcctgaatgtgaaatctcaatgtttatctccagtaagaggacacacatttcactgatattaaataactgtaaagctttacc

SEQ ID NO: 69957 - DNA, 380 bp, Homo sapiens
agacggagtctcactctgtaagcccaggctggagggcaacggcactatctcagctcactgcaacctccatctccagcttcaagtggttctaatgtcttagcctcccaagtagttgtgactgtagccacgagccattatgcctagctaatttttttattttttgtagaaatgaccttttgccatgttgtccaggctggccttgaactcctgggctcaagcaatcctcccaccttggcataccaaagtactgggattacaagtgtgagtcagcacatccagctgctatgtcgtcttctgtctcctcgtgtttctggagagatattcgttgtctctgcccatatagtcccttttgtatccagtgactctttgctgcttcctcg

SEQ ID NO: 69958 - DNA, 2458 bp, Homo sapiens
agcgagattctcgccctgagcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattaaaaacacacaacaaaacaaacacaaaaaaaacaacaaaacaacaacaacaaacaacaaaacaacaacacaacacaaaaacaacacaaaacaacaaaacaaacaagaggagggcggcgcgcgcgccgctacgaagatcatccctctcccgcgggaggccgagccacagcatcgagcacgacgagccaccccagctatgtatgcttgtaaacaagaaagaggcgtggcccccacattagacagggagacgcgaagacgaatttataacacaaagacagcgacagagaagggcagcagtcgcgcgctgtacaaaaacacacagcggcctgcgcgagggcgacagcaaacaaacgagatagacaagggggtcggagcataactttagtagagaagagagaccacccccacccaacacacaaagcggggggggggggggaaaaccaaaaagaagacggggaagcaacacaaaaaccacccacaaggagataattcaagaacgcacaccacgacggagacagacaatacaaaaacacaccataagagaagaagcgacaaacgacggccc

SEQ ID NO: 69959 - DNA, 2193 bp, Homo sapiens
agcgagattctcgccctgagcaacggcctgacgtcggcggagggaagcaggcgcaggctccgtgaggaggcaaggcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattaaaaacacacaacaaaacaaacacaaaaaaaacaacaaaacaacaacaacaaacaacaaaacaacaacacaacacaaaaacaacacaaaacaacaaaacaaacaagaggagggcggcgcgcgcgccgctacgaagatcatccctctcccgcgggaggccgagccacagcatcgagcacgacgagccaccccagctatgtatgcttgtaaacaagaaagaggcgtggcccccacattagacagggagacgcgaagacgaatttataacacaaagacagcgacagagaagggcagcagtcgcgcgctgtacaaaaacacacagcggcctgcgcgagggcgacagcaaacaaacgagatagacaagggggtcggagcataactttagtagagaagagagaccacccccacccaacacacaaagcggggggggggggggaaaaccaaaaagaagacggggaagcaacacaaaaaccacccacaaggagataattcaagaacgcacaccacgacggagacagacaatacaaaaacacaccataagagaagaagcgacaaacgacggccc

SEQ ID NO: 69960 - DNA, 581 bp, Homo sapiens
ggttggggaaccctcagggagataaggtgttggtgtaaagaggagctgtctgctcatttcagggggttgggggttgagaaagggcagtccctggcaggagtaaagatgagtaacccacaggaggccatcataacgttcaccctagaaccaaaggggtcagccctggacaacgcacgtgggggtaacaggatgtggcccctcctcacttctgtttccagatctcagggagttgatgaccttgttttcagaaggtgactcaggtcaacacaggggcccccatctggtcgacagatgcagtggttctaggatctgccaagcatccaggtggagagcctgaggtaggattgagggtacccctgggccagaatgcagacagggggccccatagaaatctgccctgcccctgcggttacttcagagaccctgggcagggctgtcagctgaagtccctccattatcctgggatctttgatgtcagggaaggggaggccttggtctgaaggggctggagtcaggtcagtagagggagggtctcaggccctgccaggagtggacgtgaggaccaagcggactcgtcaccc

SEQ ID NO: 69961 - DNA, 2259 bp, Homo sapiens
agcgagattctcgccctgagcaacggcctgacgtcggcggagggaagcaggcgcaggctccgtgaggaggcaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattaaaaacacacaacaaaacaaacacaaaaaaaacaacaaaacaacaacaacaaacaacaaaacaacaacacaacacaaaaacaacacaaaacaacaaaacaaacaagaggagggcggcgcgcgcgccgctacgaagatcatccctctcccgcgggaggccgagccacagcatcgagcacgacgagccaccccagctatgtatgcttgtaaacaagaaagaggcgtggcccccacattagacagggagacgcgaagacgaatttataacacaaagacagcgacagagaagggcagcagtcgcgcgctgtacaaaaacacacagcggcctgcgcgagggcgacagcaaacaaacgagatagacaagggggtcggagcataactttagtagagaagagagaccacccccacccaacacacaaagcggggggggggggggaaaaccaaaaagaagacggggaagcaacacaaaaaccacccacaaggagataattcaagaacgcacaccacgacggagacagacaatacaaaaacacaccataagagaagaagcgacaaacgacggccc

SEQ ID NO: 69962 - DNA, 2556 bp, Homo sapiens
agcgagattctcgccctgagcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattaaaaacacacaacaaaacaaacacaaaaaaaacaacaaaacaacaacaacaaacaacaaaacaacaacacaacacaaaaacaacacaaaacaacaaaacaaacaagaggagggcggcgcgcgcgccgctacgaagatcatccctctcccgcgggaggccgagccacagcatcgagcacgacgagccaccccagctatgtatgcttgtaaacaagaaagaggcgtggcccccacattagacagggagacgcgaagacgaatttataacacaaagacagcgacagagaagggcagcagtcgcgcgctgtacaaaaacacacagcggcctgcgcgagggcgacagcaaacaaacgagatagacaagggggtcggagcataactttagtagagaagagagaccacccccacccaacacacaaagcggggggggggggggaaaaccaaaaagaagacggggaagcaacacaaaaaccacccacaaggagataattcaagaacgcacaccacgacggagacagacaatacaaaaacacaccataagagaagaagcgacaaacgacggccc

SEQ ID NO: 69963 - DNA, 467 bp, Homo sapiens
tctatattcctatgactaaatcattcccatgctacctgacaggcctaaaaaaatctcttctcaatgcatttaaatacatgatgtattttattcatttcattttttgttgaagaaatctttcatggaaccctctgtcttcttccaataggactggttactttggttgcagttcagaaaccaatacccagaaatataacactttgacatgctaaactaaaaaagcagcagcaaggtctctctgacctcctcccctcctcctctcaatccgttatctctcccaaagcacaagatgaggctctccgctgaagctctattatctgcccagaaactggatacccaaagaggaacacaattgccttccatattccctgaaattatctatagcagagaagactaaagaatgcaaccacacagtggacaggcatttcaactaggtattatctgcttctcggctcattcaaattcta

SEQ ID NO: 69964 - DNA, 440 bp, Homo sapiens
cagccacgggaagggatgtgaaggggtttgtggaaaaaacacagtgcctgcagtttcctgagaccgttttcacttaagcctcttgtttctcattgccttcctaggtactcgcacacctgccagagctcatgtttgtatttatggttaggaacattttgtcactgcagttacctgacaaaagaaggttgaacttttttgtggagactttcaaaagcagtaggataataggattggatcttttggtttgttagtttttgtaaagtgacctggtgaagagtgaacaatggattgagtagttaggaggttgtaggaatcaatggggagctgagggtggggggcaggttcacaagagcccaagccctgacttttgtcaagcttggcatttcccagagacaccctgagcacattacattcccagggtacccacagaactgcccccg

SEQ ID NO: 69965 - DNA, 1076 bp, Homo sapiens
cagacatgagccattgtgcctgacctagttctgctttttatgttctaagaagtattatttattctatgctgagcttacatagaatttcttccatgttttctatagctatagtgtatttttaccttttactgttagatctatttcatgtttttattatggataatggaggaggtaaaggttgaattatattttcccccatattattgacccatagtgacaccagttttgggagatgtctttcattttcgcccttacgttgttattggcaccttttgcaaaaatcaattatttatcatgagtatacttctgaaatgatctgtttcatcaatctatttgtcttctcagtagttccacattgtcttaattatagctttagaggaagtcttgaaatttggtagtaagtcttccagttttgttattttaacaaatttctctaggctgggcatggtggctcatgcctataatcccagcactttgggagccccagacaggaggatcacttgagcgcagaagatcaagaccagcctgggaaatatagcaagaccttatctctacaaaaaaatttagaaattagctgggcatggtggcacccatctgtagtcctaactgctcaggaggctgaggtgggaggattgcttgagtccaggagttcaaggctgcagtgagttgtgatcacaccattgcagtccagccaggttgacagaatgagaccctgtctcttaaaaaaaaaaaaaaaaatcctggtgatgcttttctggattaaaaaataaaataaaataaaaattggcctcactactctagcttatttgcattttctaataaatgttcagagtcaccttgtcagttcctaccaaaaagcctgtcggtattataattgagattgcatgaagtctgtagacaaacttgaagagaattgacacttaacagcagtgacttccagtctgtaaccttagcataagttctatttgtctcctttaatttttctcagaaatacctgtagttttctgtatagagatcttgaatgtattttcttaagtttattaatagacattttcacaatatgtaaattcgtttgt

SEQ ID NO: 69966 - DNA, 416 bp, Homo sapiens
gctagttaaatgatctagtttgattttgggttaatttagagggatgccacgtggacttgtttgtgtttgtgtataatgatggccacagcagtgagatcctgaactgactatggtatcccaggggtgtatgggactcaataaaggcatttagggtgagagtgtagggttttgatggacattcagggcaggacacttgacgttaggatcaccaaaggaagggaaatgaaactgagactgttgcataaaactgaaaacataaaaggattctcatttgtgaaaggactttttaaaaactttattcaccagcccagggtagcaacaaggatgcatgtttctattaggagtggaaaaagaaaaaaaaagagtaaatttaaacccaaccctattttgtggggagagtatagctccaagtcaaa

SEQ ID NO: 69967 - DNA, 395 bp, Homo sapiens
  misc_feature (41)..(41): n is a, c, g, or t
ggaaggcaggggaggattggacacaaagggggatgggattntccccagtgggatgacatggtgaaggaaaggaacaggaggaaacagccaagatggcccagagaattcattgcaagtaataattcagagtcagagcaccaagagaaagtcccctgccctaacaccagacacacacacacacacacacccctattcactgccaccaacatcaccaccaccaccaagagcctctagattgttagaaaagacaccagatatactactatatttttcatggggttcatacccattgttgcttaaatcttaaagggcaaagaagtccaagcaattagagatcttggacacatccaagaactaaaatctgagtctgcactctaagcaggccaccctgaact

SEQ ID NO: 69968 - DNA, 475 bp, Homo sapiens
taagccaccgctcatggccttatgtgggtttattaaggatgccacgaataggttagattccccaatatcatcagaacttaattcaatgggtctaaaatttctgtaaattattgagagttcttctgacaaactatgaaaaaaaaattgctttggtaaagcatttgctttgttttgacaagaattacaaacgatttgcctcacattaagttatttggattttaaagcaggaataaatgcagtttgtttgatacctcattgaattacctattaattggcctacctaaaatacctaaaaaatttcaaatgctctaacacttgtaactctgtaacttattttatatatattatatgtatacatatatatgtgtgtatgtgtatgtgtatgtatgtaaagctaatatgataaaaacacattttttttctgttaagagttcattcaccttaaattacttaacatggactgttggaaactgga

SEQ ID NO: 69969 - DNA, 3494 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 69970 - DNA, 3363 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 69971 - DNA, 2909 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggtgcaccgagggactgggtgtggggaggaagcgggatgggggttggagaaagggacagaaggcccaggttgaagttccattcctgttggcacgcagaatcctctggcctttgggagggtggagtggctgtgtcaatcagtctctgagccagtggagggcagggctcgtggtctgtgttttcatcacaggtccccaccccccacacacacacaca

SEQ ID NO: 69972 - DNA, 2899 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggtgaggccaccctggcgcctcgtccccgatgggaccacaaggctgccctgccccctggtggccatgtgggcaagtacaggagcctgtgggtcgggggtcagagtcctgggctggggctgggcctggggctgtgcccagtgactggcaagaagagttgctgctggaattatttaggaattttgagagccattgtcatactcaaccattattaaaaatcatactgtaggccgggtacggtggcctggaatcccaacacttcggaaggctgaggcaggagaattgcttgagcccaggagttcaagaccagcctgggcaacatagcaagaccccatctctacaaaacaaacaaaaaattacactagataaggttaaactatatgaacctacaatatgaacctaaaaataatattaaaaaccaaagtaataaacactcagtttatcacttctaaaaaaaaaa

SEQ ID NO: 69973 - DNA, 1108 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtaggagctgcggcacgcaggtgggctggggggctgatgacccaaggcgccgcaggtgagggcacctgatccggcctgtcagtgaggcgggctgatctccggggtgttctggggtacctgatctgggctgcaaggccttgcaacagacacctggccctgtacccccggagcttccagatgtcacgagcagcaggtgctcaggtgcccctctggcccctggt

SEQ ID NO: 69974 - DNA, 489 bp, Homo sapiens
cccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgaggtgagggccccaccccaccagggctgcccctcagttccctgcctgtggcaaagacgcggagggccttagctacccacacaacacagggagcacaaaccttgtgtcaggctcctgcccgcctgtcctgtgatcctcccagccacctgccatggggcctgccacttttatccccattttacagatgagggagaagaggcacagagaggtttagtgacctgcccgggtcacacagctgtgtaagtggtggagctgggatccgaagcccggccacctgagccctaagccggagcttttcccgccagttcacgctgctgc

SEQ ID NO: 69975 - DNA, 3616 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggtgagtagtgagtggcctcacttcccggcaggcagcgcggtccctcgcacatgccacggtgcatgcctcctcccttcccaggccctcctgactccctcccacctcttggtgtttcgccccaggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 69976 - DNA, 4176 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcaaaaaaaaaaaaaaaaaaaaaaaaaaaaaaaaaaaaaaaaaaaaaaaaaaaaaaaaaaaaaaaaaaaaaaaacaacaaaaaaagagggggggcgcgccccaaaacagttacccgcggaggccgcgacactaaatcgcacgaaccccgcttctttttaagaaaggaggggcccccatagcgagggagataaacaaacaaaacgggggcgcgggcgcatcaacaacctagctgagacgagaaaaacgttatgcgcgagcgatcctaggaagagacaccccactctggggggggggcaacactggggcacccaaccacaaagaaaaaaacgcaccgcaagcacaaaaaaaccaactcagccgggcgacgcgaggagcggaacccaccacgacaattcatgccggcagaaaacaatcgggcacgcaagattataaaaaaaaataacagcggtgcgtcgattaaaacaacgcaaccaacgcagcgccccacagacactgacagagccacaacgcaataggacacccagacactgaactaccagaagctgcagcaagcgagctaaaacaacgacgagacagacaaaccacgggacaccaccgaagcagcacacacagacgaggcaaagcaaacaccacagcatcgcaccgacgagaacgcaaacgaaacacaacaaacagacacacgg

SEQ ID NO: 69977 - DNA, 2930 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcagatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatggctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctaggggtttgtgaatactcccacctag

SEQ ID NO: 69978 - DNA, 673 bp, Homo sapiens
  misc_feature (66)..(67): n is a, c, g, or t
atgctgaggtatctagaggatccggtgaggtggaggtgacgggggcgcaggctagtccactcgtcnncgtcacgcctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 69979 - DNA, 430 bp, Homo sapiens
ggagaaagaacagaggcatcctattcttatcctattcctattacgtggctcttccccttgtggctgactcagaaatatctctctttttaaaatttatttttattttctagagacagggtctcactctgttgcccaggctggagtggtacgatgatggctcactgcagccttgacttccagggcccaagtgatccttccttctcagccttccaagtagctgagaccacaggtgcatgccatcacacccagctcatttttaaaaaaaaaaaaaaaaaattagccgagcctggtagcatgcctgtagtcccagctactgagaaggctgaggtgagaggatggcgtgagtccaggagtcagggctgcagaggatatggtaagctatatcatgccactgcactccagcctggggaagacagcgagaccctatctc

SEQ ID NO: 69980 - DNA, 460 bp, Homo sapiens
cagccacatttgtatgggtgagtgggtacaaaacagagcttccatttgtgaaaaatggaggatatttatgaagatacaggtgtcaatgccctttcgacaaagactacctagaacatatccgtagtgttacaaattaggcttattttatatatatatattttatatatatataaaggcaaccagatatcatataaaatctgtttctgttatctaataggaacagggaaagaaaaaagctctgctatgcaaaatggtcaaaatatatgattatttaattcataaataaaattgcacaaatgcaaatttatgcacaaactcactggtaatcagagaagtaataatgagagctttgagatcagtttttccattccttgttacaaattaaaatgattggtcataattagtactgctaagtattgtggtacagggagagcgtcttcattaattactagtgaaagaa

SEQ ID NO: 69981 - DNA, 345 bp, Homo sapiens
tacaatactaaatagtgtggagtaatgactgtcgaatgctgtgtttggggttatagaatctcccctataggctttaagctccctgataactttatttccctccctccctcccacccatctagtacagtgcctgacttatagtaaagcactctaggaacaaatggttgaaggaagaaaccccaagtgggaaattagtaggggaacaattccctagcctgaaagtgtatccaagaagaatgatgtttttctggtgcttatatttattgcctaggatggacagctttctgcttcagaggattgggagtgttcatccaagcaagattgacatagacatttgatgctgtg

SEQ ID NO: 69982 - DNA, 590 bp, Homo sapiens
gaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggcta

SEQ ID NO: 69983 - DNA, 292 bp, Homo sapiens
gcaagaaatgttaaaggatattcttcagaaacaaaatgatgtcagatgaaaatctggaccaatacgaaggaataaagagcaccaaagtggtaactatatgagcaaacatcttttaaattttttattatttaaatctctaagagatacatgtttaataaaaaaacagcaaaatgttacagagtttataacatatgtaaaagtcaaatgcatggcagcaatagcacaaagtgcaggagggaggaaaagaaagtaaatgaaggaatgcttttattatagatgaagtgtacaatat

SEQ ID NO: 69984 - DNA, 438 bp, Homo sapiens
ctcgtggtagggttggtgcccttgtaagaagagactccagcaagcttgctctctctctctcgccgtcatgtgaagacacagcaagacgatggccattcacagccaggaagaaaggcctcgccagaacccgatcacactggcaccctgatcttggaattccaggctccaaaactgtgagaaaataaatctctgttgtttaagccaccagtctgtttctgttacagcagcctgatatggtttggctctgtgtccccacccgaatctcatcttgaattgtagctcccacaattcccatgtgttgtgggagggacccagtgggaggtaattgaatgataggggtggttctttctcgtgctgttctcatgatagtgaataagtctcaggagatctgatggttttataaagaggagttcccctgtacaagctctctctgtttgc

SEQ ID NO: 69985 - DNA, 1453 bp, Homo sapiens
  misc_feature (1138)..(1138): n is a, c, g, or t
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 69986 - DNA, 727 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaat

SEQ ID NO: 69987 - DNA, 1169 bp, Homo sapiens
taaaagagaagtggggtggaatgagaagaaagtataagagaaaaggagaggataaagactgaaagaaaggggccagaagggaagaaaaaggagaggtgtggcacttcttacttatgcttgagtggatgagctgctgttcttggaagcgtacgaggaagttgaagcacatagaggaaactgccgtgctcagtgtccaagcagcagaggactccatgcctccatgcctctgttaacctgctgtcatcagtgcaaggtaaagacaccctcccctgaccagcatacaaatcacctgttcaaatctgttttgctttaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataaaaaaaaacaaaaaacacaaacacaacaacaaaacacacaaacacacaaaacacacacaacaaacacacaaaaacaaaaaaaacaaacacaacacacacaaacacaacacaagaaaacaacaagaaaagaaaaaagacaaaaaaaagaaaagaaagaagagagagagaggagccgcgcgcgcggcgcgccagacaagatctctctcccgcgcggcgcggggcgcggcccaagcgccgccgcgccgcgcccgccactgtctattgggacagcgagggggcgcggcccatatcaagaaggcgggtgtgtgtaaatataatttatgaagggaaagggaggaggcggggagcggagggaagaggctatcacataaacacaaaccagagacgggtgttgtgagtgatgagaggggcggagagaaagaggatgcgatgggtcaggctggcgagggggacgcgttagtgtggtgagagaggtgaggcgcgcggcagcacacctaatcagtacatgagtagaggcggggagcagaggggagacatcagcctactaattgatagtcgggcagccgcgtccgcaacactgggcatacggggtagat

SEQ ID NO: 69988 - DNA, 887 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggttggttcatgtgatcctggttaatggaacataagtgagattttatgggtgacagggagagagatcaggcttgacttgagagcacgtgggaaaagaagggggctatctcttcgcaaagatttaagtatcttataagaactgtttgccagtgcaattatgagaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaat

SEQ ID NO: 69989 - DNA, 764 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataaaaaaagtcgacgcggccgcgaatttagtagtagta

SEQ ID NO: 69990 - DNA, 763 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaatcaaaaaaaaatatcctgcgccccatttgggctactg

SEQ ID NO: 69991 - DNA, 580 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaagcttgcccaaagcaccaggactttacaaggttgaccttaaaaagaagcttgtttaaagaggacccctttttaagccaaaaagagttcccagggtttccgtttggtggatttgg

SEQ ID NO: 69992 - DNA, 572 bp, Homo sapiens
taaaagagaagtggggtggaatgagaagaaagtataagagaaaaggagaggataaagactgaaagaaaggggccagaagggaagaaaaaggagaggtgtggcacttcttacttatgcttgagtggatgagctgctgttcttggaagcgtacgaggaagttgaagcacatagaggaaactgccgtgctcagtgtccaagcagcagaggactccatgcctccatgcctctgttaacctgctgtcatcagtgcaaggtaaagacaccctcccctgaccagcatacaaatcacctgttcaaatctgttttgctttaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaat

SEQ ID NO: 69993 - DNA, 576 bp, Homo sapiens
  misc_feature (277)..(277): n is a, c, g, or t
ctgtagtcccagcagcttgggaggctgaggctggagaatggtgtgaacccaggaggcggagcttgcagtgagccaagatcgcgccactgcactccagcccgggtgacagagcaagactccgtctcaaaaaaaaaaaaaaaaaaaaaaaaaaaaaaaaaaacctcgtgccgaattcggcacgaggttccactgatgcagcttagaaccacacccctgagagtcgtggcaaacctttcacaacctggaaaatgttgaaagcaaccattcctatttttgnttggtttttattaaatcttgcctcgtgccgaattcggcacgctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaat

SEQ ID NO: 69994 - DNA, 509 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggtgagacgccggtcgggatatgggaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggtgagaaggggtttc

SEQ ID NO: 69995 - DNA, 1613 bp, Homo sapiens
  misc_feature (1298)..(1298): n is a, c, g, or t
tgcgtcctggggactccaacgctgggtgacattgagctcaccagcgccaccgtccccggcgaagttctgcgctggtcggcggagtagcaagtggccatggggagcctcagcggtctgcgcctggcagcaggttggttcatgtgatcctggttaatggaacataagtgagattttatgggtgacagggagagagatcaggcttgacttgagagcacgtgggaaaagaagggggctatctcttcgcaaagatttaagtatcttataagaactgtttgccagtgcaattatgagaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 69996 - DNA, 1229 bp, Homo sapiens
  misc_feature (25)..(25): n is a, c, g, or t
  misc_feature (42)..(42): n is a, c, g, or t
  misc_feature (914)..(914): n is a, c, g, or t
accgagctacgggtcccactcagtnaacggaccgccagtgtnggtggtgttccacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 69997 - DNA, 642 bp, Homo sapiens
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgtaccgatcaggggatccttctagagt

SEQ ID NO: 69998 - DNA, 1399 bp, Homo sapiens
  misc_feature (1084)..(1084): n is a, c, g, or t
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 69999 - DNA, 1399 bp, Homo sapiens
  misc_feature (1084)..(1084): n is a, c, g, or t
tgcgtcctggggactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 70000 - DNA, 1103 bp, Homo sapiens
  misc_feature (788)..(788): n is a, c, g, or t
gcacgagatccacttaagttctttgatttgtcccatcccttcaaataaagaaatttgctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 70001 - DNA, 1298 bp, Homo sapiens
  misc_feature (983)..(983): n is a, c, g, or t
taaaagagaagtggggtggaatgagaagaaagtataagagaaaaggagaggataaagactgaaagaaaggggccagaagggaagaaaaaggagaggtgtggcacttcttacttatgcttgagtggatgagctgctgttcttggaagcgtacgaggaagttgaagcacatagaggaaactgccgtgctcagtgtccaagcagcagaggactccatgcctccatgcctctgttaacctgctgtcatcagtgcaaggtaaagacaccctcccctgaccagcatacaaatcacctgttcaaatctgttttgctttaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccatatcttacttctcttcccattatcaaagtaacctctccacaggcgaactcattttgaggagataaggaaggccagttgagtatatggcccaggtgcagcttggagggccagccttctcaaatgtcctggtgtactggtggggaggctgccccctaatagagcgagcgctgagaagcagccagaccacattctataatctttgaacatgctggcagatggaggcttttaggagaatagttttttaaacattctgacaaggtccagccaggaatttctaaggacttagaaatcccagngtcatggagttgcttggggtcaacacaagtcacctcttagcttcatgccttagaattctcaactggctgtttttcttaccacctgagaaactaaatttctcaattataaaaatctcatgtattattactgttagaagtatttgcacctcatatatatctcatttacagtttgaccttgggatatcgagttgtctcatatttaggtatgaatacaggtttctattttaaacattgattctcacatgcttcttaattattcatggatgacaagccattatagtagtcccttcttatccacggctttgttttctgtgg

SEQ ID NO: 70002 - DNA, 537 bp, Homo sapiens
cattttgaatttatacacagccttttatcctgagcaacttcagaaagggaaaagttaataactttctctcatgatctcattgtattactaggttggagatgcttgatgctgcaaagaacaagatgcgagtgaagatcagctatctaatgattgccctgacggtggtaggatgcatcttcatggttattgagggcaagaaggtgagaaggggtttcttctctatccagtatgtatgttctccaccaagaacctagagtaaatcagggattgacccttgtatttaccctctgagaagaggaggctactttctacattacatgagaaaagataagcaaaaaaataagacatattgggaacaagcctggaatatcatccttggggatagatagcaaatcctaactttggcgtggtgaagaaggactagattcattttgtgtaatgtaaatttaaaaagtgtttctgatgacaggtgtcataatgtaaattaagaaataggacactggcatatttaatcacccactgcatatttccagagtg

SEQ ID NO: 70003 - DNA, 201 bp, Homo sapiens
acagagacgtgtactagagatatttcattttcctcttaagaaaaacagtagcacaagcataatgatgacaactgacatttgacctcattttctggagcatcatagaaaggatgcagtggctcacacctgtaatcctagcactttgggaggctgaggcgggcagatcacttgaggtcagaagttcgaaaccaccctagccaa

SEQ ID NO: 70004 - DNA, 372 bp, Homo sapiens
gaaagaaagaaagaaagaaagaaagaaagaaagaaaatggccccatagtgcttaagtcctcagacatgtgtcctggtgctggggacagggcttctgacattctctcaggtcagtatttgcaggtcatccaccttcgacttcaacacatgtgaccagaaaccttcccaaggcagccatccactttgctgtccctccgacggccatggctgaccactgctgctgctgtgtatcctcggtgacatctggccttggcagcctatggatttctgccattctcctggcatgaaatcactccttcttgttgttttaatttgcatttcttcagttaccagcgcagttgagcatcttttcatacacttactgaccattcta

SEQ ID NO: 70005 - DNA, 502 bp, Homo sapiens
agattttttaaatctgtggtttcatacacacacatacacacacacattgttttttctttgcttatttaagaaactgagttatttgatctatagggtttccaacagtttgggttttgctgatattacttatgatgctctgtaacctgttcttctgtcacttatatttcctatgaatttgtagttatgtctagaagattgattcgattcaggttcaatgtttttggcaagaacacttcatagcaagtgccatgaatttctatcagaaggaagatactgtctgattttctctttttgtgatgttatcagtcactggaaagactgctgaccatcatttcactagaggttgcaaaataatgacttcctaattccattccatctttttatttttcttttttgagatggagtctcgctctatcacccaggctgagtgcagtgagccgagatcgcgccaatggcactccattcagcttgagtgacagaggtgagactcccatctcaaggt

SEQ ID NO: 70006 - DNA, 513 bp, Homo sapiens
actgctttctgtgattctgtagttaccgcagacagatgtgtgcacaaacggcatagactattattttgttgtctgaaattttgcaggaagatgagcgcaacatgtgataccttctatgtgtatttttcattccactttaaacacatcagtacacgcacatggagttcatctggatggctgtatagtactgtgttgtatgaataacccactctgcagctgttcccctcttggggatgatttgtttctgcttcctctctctctcatgcagggctgcagtggaatgagcctcaaagctctacttggtgttgccacattgctccccagaggcgccatagcttcaccttccctcgggactgtgtgagagttctcagttccctccatccttaccaaaacctcacacctggaatcccagcacttagggaggcagaggcaggaggatcgcttgagcccaggagttcaagacctgcctggcaacatggcaacacctcattctccacaaaatggaaaaaaaaa

SEQ ID NO: 70007 - DNA, 519 bp, Homo sapiens
gttgcctttccctatttaggaaagttttaagttgttagccagtcaggtttaatttaaattgtgaggtccagctccagccaatggagacaggacacagtagcagggacaagctgcataagggataaaaattgcttccctcctttgtttgggtgtgctgttgccattgtttcacctgtgaggagcaccctttctgcagaaagtaaaattgccttgctgaaaacactttttgtctaaatgctgatttttccttgcagtactgaggagcaagcattctgtttctaaataaacactttacttataacaagcccactttaaattatgtattagaacacattgagtccacttggaaaagccgattaagtcttgggctgctgtggttcctgagcatgagctttgttaagctttgtcaagtcttcctaaatactatgccaggagtttcttttgaccagatgattcctgcttattgctttgatcctggcttcatatctagatattatagatgtcctacactttttctga

SEQ ID NO: 70008 - DNA, 1280 bp, Homo sapiens
acctcaaactcctgcactcaaggaatcctcttgccttggcctcccaaagtgctgtgattacaggtgtgatccactataatcacacttggacaccacacttggccaaattcccattaaattttgtttacttgggtttcagtttttaaatagatctagtttgacaatcagcaggaaatccaatcatctttttaagcaatactggctaaatatctcaaaatttccaaaaattcctattttaccttcacattacaaaatatcaaaagctcaaaagatcaaattcaaaagatcagttcaaaagatcaaaagctacctcttatggtctgttccgaagtcataaataaaattttgctgtttcttaaaaactgtctatcatagccctactgctttttttacagctattataaaaataaaactttttccttaagtctaaaaatccattgcctccactcttgatcaataataaaaagctgactatatgagtttcctggtcactaaatgcctacttaccactcaccatatttttttttttttaaaaaggtgatcagccatataagctctgcttttaatgtaaagcacacaccagacatagtgctttaaaacaatcaaagtaaagctgtggttagcaaggcttccaaagcccagagttctttatagactcaaacttacacaggaaaaaaaaaaaaaaaaaaatcataaagctccatttactggaaggaccaaaaaagagtgagactgagagaatcaacaaattactaaactttagaaataactaagcctgtgcccttcttaacaaatgaggaaaggaaagcaccacaaagacaaaggttaagaaaatgactttcttaggccacacaattggtttacaccagacaacaggctagcatttgagtcttaagggtcatcctctcgttatcaccacaccacattgcttcacaaataaaaagcaaaaatccaattcacggcacaacctatactgaaatttaaaatgcaaatatcccttgattcagcaattccaatccttggtatttatctccagatacacaggagatagatgattgatagatagatagacagacagataggcagggcgcggtggttcacgcctgtaatcccagcactttgggaggccgaggcgggcagatcacctgaggtcgggagttggagaccagcctggccaacatggagaaaccctgtctctacttaaaaataaaaaattagccgggcgtggtggcgcatgcttgtaatcccagctactcgggaggctgaggcaggagaatcac

SEQ ID NO: 70009 - DNA, 359 bp, Homo sapiens
catgtggtgtttggttttctgctcttgtgttagtttgctgagaatgatggtttccagggaagccatgttttaaatagtcgagcaaccagttaaatacatttttatgttacgaatttataaatttatgttagcatcacttttcagtaataatgtagcattcattattagaaaaatattaggagagcctgttccttttaaaataataaagcaaataataaagcatttctcattttcatttctacaacatgggccaaacttttaatagatgcagcatatgaatttctttttctgcttcactttttaaatttccttcctacctttacctctggttggatgggaatctttctacaaaaagttat

SEQ ID NO: 70010 - DNA, 2693 bp, Homo sapiens
  misc_feature (687)..(687): n is a, c, g, or t
  misc_feature (703)..(703): n is a, c, g, or t
tgagagaccgtgttgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcangcaccctctcgggctngtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcccatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatatttacttgaaaaaaaaat

SEQ ID NO: 70011 - DNA, 3091 bp, Homo sapiens
  misc_feature (1)..(1): n is a, c, g, or t
  misc_feature (1085)..(1085): n is a, c, g, or t
  misc_feature (1101)..(1101): n is a, c, g, or t
nttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcangcaccctctcgggctngtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcccatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatatttacttgaaaaaaaaat

SEQ ID NO: 70012 - DNA, 1826 bp, Homo sapiens
  misc_feature (687)..(687): n is a, c, g, or t
  misc_feature (703)..(703): n is a, c, g, or t
  misc_feature (1772)..(1772): n is a, c, g, or t
  misc_feature (1775)..(1775): n is a, c, g, or t
  misc_feature (1779)..(1779): n is a, c, g, or t
  misc_feature (1790)..(1791): n is a, c, g, or t
  misc_feature (1794)..(1794): n is a, c, g, or t
tgagagaccgtgttgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcangcaccctctcgggctngtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacgnatnctgntcaagggcggnncantaattgggaagctttatctcggggacacactg

SEQ ID NO: 70013 - DNA, 1482 bp, Homo sapiens
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtga

SEQ ID NO: 70014 - DNA, 427 bp, Homo sapiens
agaatggcatgaacttgggaggtggagcttgcagtgagctgacatcgtgccactgcactccagcctgggcgacagagcaagactccatctcagaaaaaaaaaaaaaaaaacagtccgttttagatttcccaaaactgagaaaaatatctgagaaacctttccagctccttcatggttcactaagaaatcaacaatatcatgaagactacttacatttccaaagtatcttgaaatacggtgtcctagatagcaggcacaagtaatatggttaccagaaagatgtactcacccaccacaaatttgtaaattggcactctagatcaatgctgtcagtagaacttttggcaataatagaaacgttcgacatgtgcactgtccaatagatatcttgtagccaccaggggcgtctaagcatttgaaatgtagt

SEQ ID NO: 70015 - DNA, 122 bp, Homo sapiens
tcttaataaatcagtgttgttcttctctgttaattatatattggggtttggggagattagatttcagaagcagggaaagaccttctttacaagcagttgagtggtagactacaacttgtaaa

SEQ ID NO: 70016 - DNA, 217 bp, Homo sapiens
aatagcgcagataatgggagcaatacaaagcccatcacggctacaacagaaggactcagaaggaaatctttgtgaaacaagttaatattggccttgaataccatataagaataaaaagacagtcatttgtgttctcacttctcatattttagagtagagaatatgaagtgaacaatatttttttttttaaaaaggaagggtctcaagactttttgct

SEQ ID NO: 70017 - DNA, 715 bp, Homo sapiens
ctgtttgggttttgtagagtctggtcaacattcctaaggagaggagggatgttgcagacagcagcagttattttagcactggtatgcatttttaggtcactgcatgctacaatgcactttgtggtcacatacccagaaaacattttcacaacaggtaactccacatcttgttttctacttaatttaagggactaatagatttagtttgttttggacacatgttatatagagatgtaattatgtgatatcaacagctgaaaggggtgggggacagggcagttaaggagcagtttttgtatctttttcaaattaagctgctataaatttatgttagaagcttccttatttaggatgtcaaatgtaatcccatgataacacaaagaaaatagctaaaagaagataagaaaggaagttaaaagtttcattacaaaaatcaactaaacatgaaagaagacagataagaaatgaggaaccaaaaaaagctgcaatatatatagaaaatagcaaaatgacagaattccctcatcagtaattattttaaatgtaaatgggttaaacttcagtgaaaagacagagattagaagaatgggttttaaaaaaccatgattcaagactcctgtgccacataacatttcagtcaatgatggaatgcacataggatggtaatacaatggtaagattataataacgtatttttactatatattttctatgt

SEQ ID NO: 70018 - DNA, 442 bp, Homo sapiens
gcgctgcagccaggacagcccatggcatgaccacgaggaagctgctataaatttatgttagaagcttccttatttaggatgtcaaatgtaatcccatgataacacaaagaaaatagctaaaagaagataagaaaggaagttaaaagtttcattacaaaaatcaactaaacatgaaagaagacagataagaaatgaggaaccaaaaaaagctgcaatatatatagaaaatagcaaaatgacagaattccctcatcagtaattattttaaatgtaaatgggttaaacttcagtgaaaagacagagattagaagaatgggttttaaaaaaccatgattcaagactcctgtgccacataacatttcagtcaatgatggaatgcacataggatggtaatacaatggtaagattataataacgtatttttactatatattttctatgt

SEQ ID NO: 70019 - DNA, 588 bp, Homo sapiens
cacctgagagcaggaagtcctggtacgtaaaaactgaatgtagatgtagggaattgccctcctacgaactaagtaaaaacagattcgaaactttatcctaattggaattaaactactgcattttaagtcaaaggtgtggaggtaaatgaacaaccaaatgagaccaaggaaaggctattattcagagcttgcatacaaaggaatcctccaccccaccacaccactagcattttgacggaaacataaagattctgtggatgaataattcagaaacgttccagttggatggactgattcagggtctctcatgatgctgcagccaaggtaaaaataaagagatagaatatggacacttgggaaataataagaaaagtgagacagcactgctactgatttaaagtcagaaaaagaccactcctgggagaaacacaagttacatggtattgctcttctcacatgaaccatctccacaaccaacgtgccctgaatcccagtgcttggccaaccccatcactagtaatcaaccatcatcccaagaagcgaacataatcagaagctaaatcaaataaatatgtcttactctctgtt

SEQ ID NO: 70020 - DNA, 765 bp, Homo sapiens
cacctgagagcaggaagtcctggtacgtaaaaactgaatgtagatgtagggaattgccctcctacgaactaagtaaaaacagattcgaaactttatcctaattggaattaaactactgcattttaagtcaaaggtgtggaggtaaatgaacaaccaaatgagaccaaggaaaggctattattcagagcttgcatacaaaggaatcctccaccccaccacaccactagcattttgacggaaacataaagattctgtggatgaataattcagaaacgttccagttggatggactgattcagggtctctcatgatgctgcagccaaggtttctattacatgaagtaaagcatctgtaacctagaaatgatgggtaacgttcaaagctgatatcccagatgattctgctatgacagacttcccctgcctattgaaatcttaaggttgtctaaccccaaaattctagactatgaaaagttgtattgtaattttaaattcaggctacagaaataaaaacaaacaatctttaggaagctaaactaaggtataaccattttccaaaattcccgatttcatctattttagaaaaagaccactcctgggagaaacacaagttacatggtattgctcttctcacatgaaccatctccacaaccaacgtgccctgaatcccagtgcttggccaaccccatcactagtaatcaaccatcatcccaagaagcgaacataatcagaagctaaatcaaataaatatgtcttactctctgtt

SEQ ID NO: 70021 - DNA, 489 bp, Homo sapiens
cagacacttggggaaggggaacatctaaataaacacacctgcccctgcagcaagtgctgctgcgggaataaaggagtgaaggaaggagactgtgtatttccagtcgcatgatcagaagagcctgtctgaggcagagcgggagtttgtcgggggaaggacattggtagcacaaggaacaaggccaggtctaggatggggacagactgttgacaggagtcttggtacagtggggcacacgcctcaagggtttgggaaatacagtggtgttttggttgccggagggttgaaagctggtccaggaaagcaacttgcaagaggcagtttctccattgctcttgaagggaggagtacctcttacccaggcccagggatggtgagaggagggtgttccaggcagaagaaacagcctgtgcacaggcccaaagcagttgagggtggagagacatgcacagtgtggccgtggtatagactggatgtggtggtggggat

SEQ ID NO: 70022 - DNA, 1613 bp, Homo sapiens
  misc_feature (304)..(304): n is a, c, g, or t
  misc_feature (580)..(580): n is a, c, g, or t
  misc_feature (586)..(586): n is a, c, g, or t
gttataagggacttgtatccataatttttacaagacacttacagcttaataataaaaagatgaataattaataagatgagaaaagcacttgaatagacctttctccaaagaagatacacaaaagtcctataaggacacaaaaaatttcttaacattattagtcattcgggaaatgcaagtcaaaatcacagttaacatactacctcacacccaccatattgactagaataaaacataatagacaataacaagtattggcaaggatatagagaaatttgaacctttacacatagctggtgagatnggaaaatggtgtgccttctttggaaaacagtttggcaactcctcaaaatgttaaacatggggttaccgcgttgtcagaggtgtgtgagccagagcaaccccatcttgagtagaagctgggtaaaatgagcctaaaacctactgggctgcattcccagacagttaaggcactctaattcacagaataagataggaagtcagcacaagatgcagatcataaagaccttgctaataaaacaggtttcagtaaagaacccagctaaaacccaccaaaacnaatacnatatggtgacaagagtgacctctggtcgtcctcactgctatactcccaccagcaccatgacagtttacaaatgccacggcaacatcaggaagttaccctaaatggtgtaaaaacggaaggtatgaataagccaccccttgcttagcatataatcaggaaataaataaccatcagtatgggcaaccagcagccctgggggctgctctgtctatggagtagccattctttagtcctttactttcttaatacacttgctttcactttactctgtggactcgccttgaattctttcttgtgtgatatccaagaaccctctcttggggtctggatcaggacccctttcttgtaactgtatgacctagcaattctgctcctaggtgcatacccaagagaattggaaacacatgtctatacaaaaacttacacacaaaggttgatagcattattattcatgatattcaaaaagtgcaaacaacccaagtggtcatcagctgatggatgggtaaataaaatgtggtatattcatacaataaaatattacttgactttaaaatgggtgaaggacttgatatatgctacaacatggatgactttgaaagcattttgttaagtaaataaaagtaaaatgacacatattgtgtgatttcatttacatgaagtatataaaacagacaaatctatatatagagaaagtaaattagtgaaggaggacagtggagaaggtgagtgactattaagagtgtgggctgggcacggtggctcatgcttataatcccagcacttcgggaggctgaggcaggcggatcacctgaagtcagaagtttgagagcagcctgcccaacatggtgaaaccccatccctactaaaaatacaaaaaattagccaggtgtggtggcacatgcctgtagtcctacctactcaggaggctgagggaagagaattgcttgaacctgggagacagaggttgcagcgggccaagatcgtgccactgcactccagcctgagcaacagagcaagactccatctc

SEQ ID NO: 70023 - DNA, 906 bp, Homo sapiens
gagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcgctggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatt

SEQ ID NO: 70024 - DNA, 454 bp, Homo sapiens
gggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtcttt

SEQ ID NO: 70025 - DNA, 3074 bp, Homo sapiens
  misc_feature (2)..(3): n is a, c, g, or t
  misc_feature (604)..(604): n is a, c, g, or t
  misc_feature (968)..(968): n is a, c, g, or t
  misc_feature (1430)..(1430): n is a, c, g, or t
  misc_feature (1484)..(1484): n is a, c, g, or t
  misc_feature (1620)..(1620): n is a, c, g, or t
  misc_feature (1631)..(1631): n is a, c, g, or t
  misc_feature (1911)..(1911): n is a, c, g, or t
  misc_feature (2844)..(2844): n is a, c, g, or t
  misc_feature (3033)..(3033): n is a, c, g, or t
tnncgataaatttagatttcatagtattccattgtctagctgtctggttattataggaacttaagtctttcaatttattatataaaagatatgattttagagtggaattgctggatgaaaagggatgggcatttttaagacttatagtacatattgtacatatagtacttttagcacacttcttcagaaagattatactaattgttaaatttaattattattcataatagcattgatagtgttatttcataaaggataattatactccactgaaggattttgtatttgtattgaagttttcattcattgacagtggataaaagataaattatgcagtttttcttgggcctgtttatggcaattaccttgtgtccctgaaaattgtgtccctagtgcatgaacatgctgttataggttggcattgccaaaaataccatttatccatgagaaaataatgtctaccttacaagtttctgagaagtaaaataacccatatgatgcagttgtcataaggtcttgctcatggaaaatgcccaggaaatgatcattgaacttagttcaaagaaatagtgttcttttattaccacttaaggagcaaatgctnttaaaaagtggattattatgttaaagtctaatgaattgaggtactcaagttacttccactgatttttttttttttggagggttttttttaatcattcataatgtttttatataggcccttttacctgttgcccctttctccatttagccatttcaacagtctgatatatattctttcacataaccatttataaaaatagacacatacatatagggatttttgattatgcttttgtaaataaaaggcctattatatttttcattttccttttttccccataatacactgtcaagctagatcaaactacaatagttatacatctacatagcagtccctaaacaatattaatttccttttcctttantaattgctttaaaattcattatatttgttactatggagttatttctggatattggtgccattactaagtcttcttaagccatcttgctcacacatgaattcaaaatggtgtttggaaataatgtattatatctggagatatacaatgatcttattgtatgtcttttttaaaactagaatttttttaaggattattcaaatggagtaacctctccctgtctttaaggtcatgtttctgaaaatcccaaaggtaaaatgtattaaagaagttgaagactaggttgaaataaggattacgccgaatctatgaaggcctgtgtatgtgtattctattgtcactaaaaacagtgtgtggcacctaaatatacagaatattaataaattttgatgccttttaaatttgattaatacagtttaattttcatttatcatctctgattctagaacccttgaagttttcagnaaggtccttataaacctttttttccttatttcagctcatgcatactatgaaatntttatttctcctgaactttttcttgtctccaagtgtgcactatttttctgatttttatgaccagagttgattctcactgctagtttccacattaatttagaagagcactggtacttgtgttagactgcttggattnagatttcaacngaaccaactactagctgtgtggcctttagcaaattacttaacactatgccacagtttcctcatttgcaaaagtagggttatagttcttattttttctggtggttgcaatgctgaatgagccattatagcatatattaagtcattatagcatttcttggtgcgtggttggtacttactcaatttagattattctgcattgctgaggagatatttctcaaatacacattcctagctttgcttataaataatatgcccaagcttaggacagaagaattaatgngatttattagggagggacgcaagggtagatagttccagggatggggatataaatgagatctctcagagagagtttgggataaatgaaagagaagtcctagggcagaatggtaaaaaaacaccaatgtatttgtttagtgtgggtttttttccttgttattttttgaaggttgtatactgttttcattctgtaaagcaaaaaggccttgttttgtaggctgtcctatttctagtccaacaaagttttcagtcacagtaataatattttcaaataaaatataaatctcctttttaaaggaaaattattagtaacaagaattcttagtgctatagaatggtcataatatgataatttaaattcattgcatgtattagattataaattttgcatatactacctcaacgtatataatccaatgtaatatgtagattgaatttatttaaatgtctttgttttaaaaaattgctggttcagtgttatttacataaaattgaaatctggtctcagtgaatcttttaggttgttttcttctagtgtgataggaggctggatgctttataatggatttgatgaggcaagttatgctataaagctgctttaaagtgagaaaataattcataacaaataaatcacagccaatgcaacagtgctattgaaggaagtggtttattctccatagccgaggtggtgtactttctgaatgtacatctggtaactagaatttaaatgtttagtcagattcagtgaaatgatttcatattttaagtagtgtttttttcattggaaatttagcactgatttctttgaaattttgaaaatcttaatttgtgtgtgtgtacgtgtatctgtatgtactggcatattgaaacatttataggaaaaatagcaattgatggcaaaagtgtacgtacctggaaaacccctgtttttttntttgtttgtttgtttgtttttaaataagcttgaatgttgttttcaccaaggcattttgatctgaatgactttaaattgtgaatttgtcttagattaaaaatctgttgtgaatttgttttgaatgtttctaagccatataaatataaaaaaattccccattttgaaatctttcagatcaccttttcacantgtcagagtaatatattaatgtaataaaagggaaaaaggtc

SEQ ID NO: 70026 - DNA, 3561 bp, Homo sapiens
  misc_feature (2)..(3): n is a, c, g, or t
  misc_feature (604)..(604): n is a, c, g, or t
  misc_feature (968)..(968): n is a, c, g, or t
  misc_feature (1430)..(1430): n is a, c, g, or t
  misc_feature (1484)..(1484): n is a, c, g, or t
  misc_feature (1620)..(1620): n is a, c, g, or t
  misc_feature (1631)..(1631): n is a, c, g, or t
  misc_feature (1911)..(1911): n is a, c, g, or t
  misc_feature (2844)..(2844): n is a, c, g, or t
  misc_feature (3033)..(3033): n is a, c, g, or t
tnncgataaatttagatttcatagtattccattgtctagctgtctggttattataggaacttaagtctttcaatttattatataaaagatatgattttagagtggaattgctggatgaaaagggatgggcatttttaagacttatagtacatattgtacatatagtacttttagcacacttcttcagaaagattatactaattgttaaatttaattattattcataatagcattgatagtgttatttcataaaggataattatactccactgaaggattttgtatttgtattgaagttttcattcattgacagtggataaaagataaattatgcagtttttcttgggcctgtttatggcaattaccttgtgtccctgaaaattgtgtccctagtgcatgaacatgctgttataggttggcattgccaaaaataccatttatccatgagaaaataatgtctaccttacaagtttctgagaagtaaaataacccatatgatgcagttgtcataaggtcttgctcatggaaaatgcccaggaaatgatcattgaacttagttcaaagaaatagtgttcttttattaccacttaaggagcaaatgctnttaaaaagtggattattatgttaaagtctaatgaattgaggtactcaagttacttccactgatttttttttttttggagggttttttttaatcattcataatgtttttatataggcccttttacctgttgcccctttctccatttagccatttcaacagtctgatatatattctttcacataaccatttataaaaatagacacatacatatagggatttttgattatgcttttgtaaataaaaggcctattatatttttcattttccttttttccccataatacactgtcaagctagatcaaactacaatagttatacatctacatagcagtccctaaacaatattaatttccttttcctttantaattgctttaaaattcattatatttgttactatggagttatttctggatattggtgccattactaagtcttcttaagccatcttgctcacacatgaattcaaaatggtgtttggaaataatgtattatatctggagatatacaatgatcttattgtatgtcttttttaaaactagaatttttttaaggattattcaaatggagtaacctctccctgtctttaaggtcatgtttctgaaaatcccaaaggtaaaatgtattaaagaagttgaagactaggttgaaataaggattacgccgaatctatgaaggcctgtgtatgtgtattctattgtcactaaaaacagtgtgtggcacctaaatatacagaatattaataaattttgatgccttttaaatttgattaatacagtttaattttcatttatcatctctgattctagaacccttgaagttttcagnaaggtccttataaacctttttttccttatttcagctcatgcatactatgaaatntttatttctcctgaactttttcttgtctccaagtgtgcactatttttctgatttttatgaccagagttgattctcactgctagtttccacattaatttagaagagcactggtacttgtgttagactgcttggattnagatttcaacngaaccaactactagctgtgtggcctttagcaaattacttaacactatgccacagtttcctcatttgcaaaagtagggttatagttcttattttttctggtggttgcaatgctgaatgagccattatagcatatattaagtcattatagcatttcttggtgcgtggttggtacttactcaatttagattattctgcattgctgaggagatatttctcaaatacacattcctagctttgcttataaataatatgcccaagcttaggacagaagaattaatgngatttattagggagggacgcaagggtagatagttccagggatggggatataaatgagatctctcagagagagtttgggataaatgaaagagaagtcctagggcagaatggtaaaaaaacaccaatgtatttgtttagtgtgggtttttttccttgttattttttgaaggttgtatactgttttcattctgtaaagcaaaaaggccttgttttgtaggctgtcctatttctagtccaacaaagttttcagtcacagtaataatattttcaaataaaatataaatctcctttttaaaggaaaattattagtaacaagaattcttagtgctatagaatggtcataatatgataatttaaattcattgcatgtattagattataaattttgcatatactacctcaacgtatataatccaatgtaatatgtagattgaatttatttaaatgtctttgttttaaaaaattgctggttcagtgttatttacataaaattgaaatctggtctcagtgaatcttttaggttgttttcttctagtgtgataggaggctggatgctttataatggatttgatgaggcaagttatgctataaagctgctttaaagtgagaaaataattcataacaaataaatcacagccaatgcaacagtgctattgaaggaagtggtttattctccatagccgaggtggtgtactttctgaatgtacatctggtaactagaatttaaatgtttagtcagattcagtgaaatgatttcatattttaagtagtgtttttttcattggaaatttagcactgatttctttgaaattttgaaaatcttaatttgtgtgtgtgtacgtgtatctgtatgtactggcatattgaaacatttataggaaaaatagcaattgatggcaaaagtgtacgtacctggaaaacccctgtttttttntttgtttgtttgtttgtttttaaataagcttgaatgttgttttcaccaaggcattttgatctgaatgactttaaattgtgaatttgtcttagattaaaaatctgttgtgaatttgttttgaatgtttctaagccatataaatataaaaaaattccccattttgaaatctttcagatcaccttttcacantgtcagagtaatatattaatgtaataaaagggaaaaaggtcactcatgattttcttaccttgagataacataatttatctttgccttattttttcagtttttgtctatgcgtttctattctttatgttgttaaggttatattatacatacatttctgtatcctatattttcctccttttctttatatatttttaaatgtggaataaatttttagatttcaatttgattcagaatacttccaaaatattgattaagagttataaaggcatttttaatttaaaacaaaaactagtgttctacattagtgtttcacatctctagagatactaattaaaattgaaattacttaatgccacaagtttacttttaaaaattctcccttgtaatatttcttacattcagttgaggattttatgtgaagaaagaaaccgaacttgatggtttggattgcatttaagaacattatccctaggcaacagtttttattaactagtaccctattttatgtcaatgatagtattaaaatgt

SEQ ID NO: 70027 - DNA, 1760 bp, Homo sapiens
  misc_feature (1712)..(1712): n is a, c, g, or t
  misc_feature (1760)..(1760): n is a, c, g, or t
gtcgaccctttccacccctggaagatggaaataaacctgcgtgtgggtggagtgttaggacaaaaaaaaaaaaaaaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtagggncccacttcaccgtactaaccagggaagctgtccctcactgttgaattn

SEQ ID NO: 70028 - DNA, 1356 bp, Homo sapiens
gtcgaccctttccacccctggaagatggaaataaacctgcgtgtgggtggagtgttaggacaaaaaaaaaaaaaaaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatggaggctgcagtgagctgtgaaagcatcactgtactcctatttgcccggcggaacaagtccctatcgaaata

SEQ ID NO: 70029 - DNA, 1354 bp, Homo sapiens
gtcgaccctttccacccctggaagatggaaataaacctgcgtgtgggtggagtgttaggacaaaaaaaaaaaaaaaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatggaggctgcagtgagctgtgatcacaccactgtgctccagcctgagtgacagagcaagaccctatctcaa

SEQ ID NO: 70030 - DNA, 321 bp, Homo sapiens
ttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgag

SEQ ID NO: 70031 - DNA, 234 bp, Homo sapiens
ttaaaattcaagatacccttcagtgtcccagatttaggaagactccccagagcagaggatgaaggacatgtgagttagacagagggaacagcttgggcgtcacgtgagaggaccacagctcaccaagagatgcagatttgatactcagactttacattcaggatcgtaggaatcaattctgctgtcggcacagtctcaggccgtctgtgtgaagttgagagaagccacagctgg

SEQ ID NO: 70032 - DNA, 405 bp, Homo sapiens
attaattccacaggtcagtttctctgaaacattttttcactaaattctaagtcttcctggagttgcaagtgcctatctcctagacaaggcaattactcaccaactaaaatcactgtcaatctgagatttcggctgggcatgagaccatggtcaggggatgctttgaacagcctctgaggaaattagtgagtttgaaaaatggaaagatttttattactcacttggcagtaaaacctgatggggacagacgtcaggctgtttaagatcctcagaagaaaaagttgatagtgtgaatattcctaaatttgccacacgaagatgtacatgtgattataaggtgctgttgcagaagcccctgggggtgttatgggatatacactatatgggccactttaccttcctaaa

SEQ ID NO: 70033 - DNA, 2375 bp, Homo sapiens
  misc_feature (340)..(340): n is a, c, g, or t
atacatacccaaaagaaaggcagagactcaaaacatgcttacatgcgggtgttcctagtaattcacaacagacaaacattagatagaaacaatcaagtgttcattagcagatgaaaggatacgacgtgatacatagactaacaatacaatattcagccttcaaagggagtgaaattctgatacatgctacaacatggatgaaccttgagaatattacatgaaataagccaggagcaggacacatattttatgattccacatatactagggtacccagaatggtcaaattcatacagacagaaactggaatagtagttaccagggactgtttggtggtgtncggggtgggagtgggtgttaagtttctgtttgggaagatgaaaatgttctggagacgtatagtggtgatagttgcacagaaatgtggatgtacttaaagacactgcattatacttgtaaaatggttaaaatagtaagtttgatgctgcgtatactttaccagggtaaaaacaatgcaagagaaagattgccagtgcatgctgaaaattaagattactaggaggatatttttcactcttgagactaatgacaacaattgaatgttgggaagcacagtatgtgggagtgtgtaagtgggtcttgctagtaggggatgtcactttagcaaaatctgttggaagttgcttatcttttgtgtgtattaacatgaagattttctcagttgaataaaacaagttaaagaatactttctttgttgtaaaacagcatatttatatacatttataaatgcattaagttctagaaggatacatgagtaaaaatatgaatttaaaaattaaagtcacagatttaggtgttgtcacctacctaccttatggttttttcctactacacttacatacctcttcataatctgctctatgtttcccatgtaacaccactattacaaaatagataaagcaggctgcctttgtagcagtaatttgagtttcatgtgtccccatgtcctgctcagtattacagcaactgtcaaaacacaacaggaaagtaatgattagaagtgcacttattaccagtatcattttagatcttctgtatattgaaaaggatttgagataccagaaaaatataggtaagaaataaagtttgactttagtttatgctctttacagtagtttgcaagggtacctataacaagagttgaagtgataatattttaaaccctagaaagaggttatagcaacagatttttatgcgtctagtctttggtaggctgccctgccccagcagaatttggaaatacaagtgaataatttataattataaagcattaagaagttttgtctcttaaatacatagaatttaaaatcaaagggtgatatttacagcacatatcaaataattggtcagatatacaagtcacagaaatgtcaaatgggagagtgaaggaaagtttaaaatagcttaggaagagatcacaaaatatcctttgaaagatcataggcacacacaagtcaacactagagctaaaaccagatattattccattactaaagagtgattttgaaagaccatttaaagtaggagtatccaatcttttggcttccctgggccacattggaagaagaagaattgtcttggtccacacgtaaaataaactaatgatagctgatgagcttttaaaaaaattgcatgttttaagaaaatttacaaatttgtgtcgagccacattcaaagctgtcctaggcttcatgtggcccgtggcccatgggttggacgagcttgatctatagtagtctaggtttccttaatgcttggaaaagtttgcattgaagcagtgagagtagggctgatatattcttcaagcgcagaagaaagcattgaactgactttttaatgaaaaacactacattctctcacgtaaattcattctttgtgtttagctcttttcaaagatgtggattttctgtttatgttcagtttgttgcaaacatgtaaaacatgttattaagcatattagcctcatatcctaacaaattagacaaaaaggtttcagacaaatgaagttgttaattaaaattatgtatttgtaggccaggtgcggtagctcacgcctgtaatcccagcactttgggagactgaagcaggtggatccacgaggtcaggagatcgagaccatcctggctagcacggtgaaaaccccatctctactaaaaatacaaaaaattagccggtcgaggtggcaggcgcctgtagtcccagctactcgggaggctgaggcaggagaatggcgtgaacccgggaggcagatcttgcagttagctgagattgcaccactgcgctccagcctgggtgacagagcaagactccgtctc

SEQ ID NO: 70034 - DNA, 1703 bp, Homo sapiens
ggaaggacagggctacttgtaggaatgttactgatgaggcaagatgccaaggacttccctgcagggtatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggcctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacatgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggacatgcagggaggaagggagaaatagcaaccaatccaaca

SEQ ID NO: 70035 - DNA, 1914 bp, Homo sapiens
ggaaggacagggctacttgtaggaatgttactgatgaggcaagatgccaaggacttccctgcagggtatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggcctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacatgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcgggaaaaaaaa

SEQ ID NO: 70036 - DNA, 1890 bp, Homo sapiens
ggaaggacagggctacttgtaggaatgttactgatgaggcaagatgccaaggacttccctgcagggtatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggcctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacatgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcgggaaaaaaaa

SEQ ID NO: 70037 - DNA, 1423 bp, Homo sapiens
ggaaggacagggctacttgtaggaatgttactgatgaggcaagatgccaaggacttccctgcagggtatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggcctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctccccttcctccctgcatgtcctgtccccagagccccccaccccaccctgggccaggtcaggccctgtgggacgggagaaatagcaaccaatccaacagcgggaaaaaaaa

SEQ ID NO: 70038 - DNA, 1697 bp, Homo sapiens
cagcaccttctctgccttgggtccgcgcttgttgtcataggacacttggtcgaggttttcatagttcctttttttactcttggactcacgctcctccagcagcgtctccaggcgtttctgagccgcccggccctcgtggtcgtcgctgaccagcaggatgatgtggttccagctgtagacacgcatcatctcaaaccacacgctggactggtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggcctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacatgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcgggaaaaaaaa

SEQ ID NO: 70039 - DNA, 720 bp, Homo sapiens
ggaaggacagggctacttgtaggaatgttactgatgaggcaagatgccaaggacttccctgcagggtatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacacacatacaatgcacacatccgtactgcccgggtaccggtc

SEQ ID NO: 70040 - DNA, 179 bp, Homo sapiens
tttgttacatagaatgaggaatttaaaatgaggccatcgcatgtctacaattacaaaatgatgcaaaaatgaaaaaaacatgtgtaatacactacctggttttctcataagccccacaagtatgtcaaacagagggtaagtgaaagctaggctatggctgctaggagaggtgtgattct

SEQ ID NO: 70041 - DNA, 949 bp, Homo sapiens
actcctggccctgaagcagtcctcccaccttgatctcccaaagtgctgggattacaggtgtgagccatcacacccggcctaacatttattctgtttttttttttggagacagagtcttgctctgtcatccaggctgagtgcagtggtgcaatctcggctcactgtagcctccacctgcgggattcaagcaattctcctgcctcagcctcccaagtaccttggaattacaagtgtgtaccaccatgcccggctaatttttgtatttttgatagcgatggggtttcaccactgacatttattcttaatgttacctttattctactgttttggcagttgtatcagccaatgatattttaaattatgtccaccataattacatgattctcctctttctatcaatgtttaagtggctccgtgactcacctactgctaatcttgagtaagttacttaacccctgtgtgcctcggtttttaggctcacaaaatgggataatgatatctcattagattgttgtaagaattaaatgataatacctgcaatcatgctggtatagtacttactcatagcaagcactcaataagtacagttattatcattatatactacctgtggatcttttgttgctccccacgtggaattgtacagataaatggaaaaaggtttagtgccttacactgttatgtgactggatgcatctgtatatgtgaagtgtaaaaagatgtcagtgtacatgctgttaacttggactagtggtagaaggcaggaaataagaacaaattttaagctattaaacattttgtgtaatactaaatttaaaaaatttttagccttgtgaatacacagatttgatctatctttaccttatttcttttccatgtatatatttaatgtgcaaagtatctatgtaatggtcaaaatatatttaataaatagaaacaatttttctat

SEQ ID NO: 70042 - DNA, 5388 bp, Homo sapiens
tttctttctcttgtactctacacccaaaacatcagaaaatccttttgactctgacatcaaaagacatccagaatatgacccatttttacaattcctcttgctacatagctggctcaagccacaatcatcttagagctagattaagagcctaggtattataacagattattgttataataggtcattgtgatagatctccttgcttctgccctggttccctataggtttacactcaacatagcagttaagagcttttccttgaatatattaggtcatgtcactctaaataaaagccctgaatggtttcccagcttcctcagagtgaaagtcaaagtccttacagtgacctataacaaactcaaactataacaaaacaaagttttcttccctcaccttgcttctctgaccttagctattactattctccacttctcattctgttgcagacatcctggtctccttttggccctcagagactccaaccaaactcccacctcatagcatttgtgtcctgctgttccctttgccttgactgctcatccccaagctacccagaatgtttgtttccttgtttttctcccctcagttctattcttaaacataacttattttattttattttgttttatttttgagacagtcttgctctgttgcccaggctggagtgcagtggtgcaatctcggctcactgcaacctccacctcccggcttcaagtgattctcttgcctcagcctcccgagtagctgggattacaggtgcacaccatcaaggctggctaatatttgtatttttagtagaggtgaggtttcaccatgttgaccaggctggtctcgaactcctcacctcaagtgacctacctgtctaggcctccccaaatgctgggattacaggactcagccaccacgtccagctacataactttattatagaaacccctgaacactttacatcaaaaagcatcactcactctaaccctgtcagagccccccaccctgctctgcttctcttcataacacttaataccattcagcactatgcattttctggttttttcctgtccttcctcactaacacgtaagcttgatagaaggagaagctgtatgtgttttgctcagtgttgattctccaccacccagaacacctcctagcataaggtcagcactcagtaagttgctgaaggaaagaagggatgggtttgagcagagtggagatggagatcagctgatgaacttttgagatctagtaggtggcagaatagtcagattgtgatgaattgttgggtattgagcaggaaaagggagatgaaggaaataagagggctctaggaggctctccaagtttctgccctacacactgagttgatggtatactgttccctgaaatagagaagatgggaaaaggatttgattaaggacagggacagagaaggataatttcaactttgaggaagttgagattcaggttattaggacatattcaactgaagatatcctggaggtagctggctctagaactattaactgagtttgtgctgaacactcatctctgttaggtacaaaactgcatggaaaggagatgaagagagactgtatagtattgagtcattttccagggaaaagctaaatccttttcaccccttcaggtgaacttaccaaaccagctgctactcagaagctcacagcctttcagaaaaaggtattctccaagcctccaaggagtcttattgtctcaaggcaaccatttttcagtttgactctaggggtgcgtgtttgccattcagaacctactatattttaccgcacctcctgacattgttacacaacatttattgaaagcacatttgatggtaatgaagtttctattaactatgattaaatctcataaagcacctgaagataatttaagatgtgcagaagcagaaaatgaaacattcggtttagtacattaggaaacgtaattgattaaattatctcatttacaataagtgctttcatgagctatgcagtgcacatattttccccagtttgtcattatgatttgccaacagatatcttaagacttcactttctttttacacctccccgcaactctaagctcgtgcctctgcctgcctgctcatggagcactctgtgcagagctctgagtgatgttttctatctgccaggccttatggaagatcatgtgtatggctatatataggcacaggttgtttctcaattatcttcataattgactttgattttgcattagtgatgattcatgtagtctcacattaagcccctctttcactgaacaactgcagcctgaatttctataatgcactcctaaccatgcagcttacagaaccccgattggattcctctgggagccttttgcaatcacattgattctctaaggtcttatttttagagaaatcacaaattaaaacagtttaagcgattccgttgcagtatccagcaattaagcatggtgctcaggaacgagaaccccaagcaaaaactaattctgaagtccctaaggactggaaatggcttctgcggggtttatgcctggaagtacagatgtaaccaaattagaatggcacaggactcacaaactaagtgtgaaattaattttaaaaacacatacatgcatttctaagtaactctcacattggccaccccatggatacctatgatcttttttgtgctatatgacagaatcagtggacagcatgcaccatgtggccgggagcaaggtaagagtccacttactccacctgtcatcctgagggtcctgacacaagcacaggccaaatattcagtgatctgtttatttctctctccctcaatgcccatacacatgaacacacatatacacagccaggtgcccccaaactcagtcttcccataaattcaaaatcaaacatgcatgatgtcagaggaccaatacttaagtagtaatgattttttttaatgggcagcagacagcagggaaataagtttaaatgtttatttttgctgttttcccaaattcttagactttgcaagtaatgatatctttgtatctccagccttcctgaagcaacataaggaaataggaacagaatggctttactggatttttccctcatgtcttgtgacccctgtcccaagttacctatttctgtctatcctcacagggtcttaattctctcaaagaagttagctcataatagctattaactcttccaagctctttgaattttaataccctaagatttaaaagatcaaaagtcattcagttgatactagaatgagagatgctaggcagggacgtctttcacaagctttacaaaccaaaccagccaggccgttgtctaatctcctactaatgagagctgtattaatgttgccccagtatcttgaagtttccctagcgtcctttacatatttctgatgtatgagaatgacttggggaacatattaacacatagattcttaggagctcctcaaccaggaattcaaatttatttgttctgttctgaggtggtgcatatttaatttaacaagctccagccacactctgagattctgatgcatgtggattctgatccaccttttgagaaacatttttctaaaatcatggttctcagccccacctgcaccttggagtcacctgaggagctttgaaaaatagagatacctgggtcctgaaaaccctccaccttaaattccaatagccttgatacagcctggaaattgggaattttaaaaggcctacaggtgatactaaagagcataaggtcaaatgccatactgctagccattccagccatctcctctctccagctctgcaggaagcataaaatgaagacaatgcaaaggcctctcccataagcaagcctgggtacaacgagcctaagccagtaccaacaccccaatcctcagctcgtcattatttcaccatggagttctggatcctaatctgcccagctgccatggattccacaggagattcttatcaggatgagaaaagcagtgagctttcagcctgtcactctattatatacaaccagaagcctgctcaggaacgaagattactctgggtagcagaatgaaactccattaaaaacaggattgaaaggctgggtcttacagaggagatcagatcatgaggactctcccctcatgaatgaatgaaagaatggattaatgaattaatgggttatcatagaagggaaactggtggcttcacaacaagatgagagatctgacctcgaatatttgcctgctcagcctcattgccatgtgatgccatgtcctgtgccacctctggactctgcagggagtccccaccagcaagaaggctctcaccagacatagctcctcgaccttggatttctcagcctccagaacggctctacagattgattttaaagccacctacactgcagtttcttcaatttagctctacttatctgattatgcatcacaaaaggaagcagaaattcagcttaattgtgaagccattgcagcagaaccaagcaaatgatagaaaacctcatgatcacagacagaatcacactcactgatgctgaatgaaatgacagacatccgtccctctgcagaagcctgaatactgatcacagaattttacgttctgacattgtgtgtctcttgtcagatagtgttgtcctttactttccccgcttcagttgtgaaagtcaggtgcagtctcatactatttttttttaaaattcattatgacaagtaaatggtctctgggaaagcgaacatcctcatccactgtttactgaaactgtaacactgtcatgagtgaagaatgaaacatgtttaatgtaaagagtttgcagaatgatgatcagaggaaaagaacattaaacagaagaaacataaatataagaatggggagagagatgtaatcaaaagacagcttgtaagggaggttacatgctgccatttgcttttcagctgtgttttccatagtgggacagatcttgctctttgttacttctacttttgctttttcccatctgcaaagagggaaacaatctgcttttgaatctctggtgaagcatcacctagaagctgctgccaaagcttgatatccagagtgctctaaaacatagtgtgatgtgccctttcatcttaaaggattatttttggctgggcagacctctctaagatagattataaggagctggcttttaaaggcaatgaaaactgcttctgtattcacatttaccccctccctccattatctgaggtatgtaaataatgttttaaagtggtgatgtgagaatattaattatgttttcatttcttgttcctgttaccatgtaatatatcttcaagtgctgagaaaacatcttacaaaaccattaaagattccaaatgttcatacat

SEQ ID NO: 70043 - DNA, 1108 bp, Homo sapiens
ctgtctgcaccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggaga

SEQ ID NO: 70044 - DNA, 587 bp, Homo sapiens
gggaggcagagagcagaccaacccagtagtaaggaagatatgatttgctacaacctatttacctgacatgaaaaccagaatgcatcattgttacattttattagtgttcaggctggatattataccatggtagcatgtcgtttgacatcactggtagatcttgttttttcttgtataataaaataaaagataggacatttcctttgtatcagttttgctgtctttcctctgcaccagtaacaaaaagtaaatgttctaaaagtatgcaaatatgaatctaaattgatgcaaactgaatgtgaagacagagtcacatttatctactacggttagaaataccaaactggggaggattaaacatcatcatagattggacccccagctgttgtaatgggcaggatcatagaaggaagatcaccaacgaaaagaggaactcatttcagttaaaaagaaaggtcccttggccagtctcagctactggggaggctgaggcaggagaatggcgtgaacccgggaggcggagcttgcagtgagccgagatcgcaccgccgcactgcagcctgggcgacagagcaagactctgtctc

SEQ ID NO: 70045 - DNA, 445 bp, Homo sapiens
tatttcatttaacttgaaactaaaatgaagctagctattttctccctcctgcccttccttccttgtttccttctttccttctttccttctttccttccttccttccttccttccttccttccttccttccttccttccttcccactgaagccccatcattaatgcaaatccaccctctcctctcccctacttctctacatccacacagctgtcttttcccagctttgaaaatatgtacattagctgaactagagagctaaggtatttcactattcaaagaagagtatttcttacatatatccatatcacaaggcttttaaactatttttgactcctataatttctataactctttacaagtctgatgtagacaccagttggagaacttgagaattaagtttaatgtaaaggatatcaaagagataaaagataatagaatttcaaa

SEQ ID NO: 70046 - DNA, 419 bp, Homo sapiens
agagacagttctgtggttaggataataaactcagcgtgagactgaattggtggtgctttaaaccagattgttacccgctgcaaagcacagtaagatgaggtatagcatagtgcagtaggcttaacaatttactaagccatgaatgcatttggacttatttacaaagtaagaaaataatattcggatattctgtgaagtttagatatcttgctaacataatttttttcttttctttttctatgcctcgccaggatagattgccttttttcatgataagaatgttgtaatttgctttgagaagttctcatattggttcttttgttaatttatatctctgtaagagttattctctgttcttatccatgcttttgtgtgcctggtaatgtttatgtttctttgccaaaaaaacaacttattta

SEQ ID NO: 70047 - DNA, 169 bp, Homo sapiens
ttaaaaacaaaaaaaaatgcagagctgcgctttgattaattcagtgaacaaaacatatgctgttggttctgttctatgaaattcatatatgatcaataaaatcttttaaaagagcaactttggcttttagaattatactgccgaccatgttttttgtcccagttaactc

SEQ ID NO: 70048 - DNA, 319 bp, Homo sapiens
acagctggactctgctcccagaatggactgacttcagcttcagggatgacacagagactctgggaccttcttaggaaggacacaaggagggattttcagaggctttggagtacagtgtgtgtttgcttctcaactttgcccccacttgggctgtctgctttagagtggggacagtgaactaggcatggtggctcacacatgcaatcccagcactttggaaggtcaaagcagaaggatcacttgagcccaggagcttgacaccagcctgggccacatagtaagaccccgtctgtactaaaaataaacattttgaaaatta

SEQ ID NO: 70049 - DNA, 479 bp, Homo sapiens
aagtgatcatgtaaaatatgcataaaatatacacataaaatagtcaatagttgctcatttgttttagccactgaaaattgactgagttctccacttggaacatgtaaggtagtgttgactttacttgaaaggctgacatccatttcagataacggtgtctctttttattttatcatcctattatattctcttctacgtgatttgccttctctgcttttcatgttgtgtaaaattttcatatttttctaaaagaaattttggaacatgaagaatgcatacaagcggtctgcagacccatctaaactttgttagtagactttatatctcactgcggctcaatgacctggaagataaactggccctgtctgttccatcagaacaacaggaatttcccgagttcaggcaaacagaagtttgcttttgtctgatactcaaatttctctctcaatcactcagattctccagataattgcctggct

SEQ ID NO: 70050 - DNA, 471 bp, Homo sapiens
tttgagcaggaatggggccaaaccacccaattacattccattattttggaggaaccttttaacttttgaaccctagttgtactgttaatttgaaggtatagctactaccaaatagtctttgagagaaataactggaacagattggtttgactgaaaacagtaaaggaaatagaatcagttgtctgactactagctttaaatttagacgtttaaaattcctgaatattttacactttagtttcatctttagtctaaagaggcccatcaagggaagatgcctctatccctttagaaacaacagggaaacttggttttagaaaggcaagaaacaaagtatattggaaagttttccttctcgggtaactggagtgtttaagaaagaaggtcattctatgagcatggcattttagaataattgtactttaccagaaacctggttctcaaaaaatcttccagctttttaaaaaaaaa

SEQ ID NO: 70051 - DNA, 2263 bp, Homo sapiens
  misc_feature (2108)..(2108): n is a, c, g, or t
gagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccnccccccccaccacgcgctcaatcatgagtacctcaaaggattgttgggcttgggggaaaagaggtggattcctgggcaagaacctaaagtagcaggactcggaattctcgggaaattattatgactcaataaaagaattcacaccttaggtgtgg

SEQ ID NO: 70052 - DNA, 1967 bp, Homo sapiens
  misc_feature (1802)..(1802): n is a, c, g, or t
gagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccnccccccccaccacgcgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaac

SEQ ID NO: 70053 - DNA, 2273 bp, Homo sapiens
  misc_feature (2108)..(2108): n is a, c, g, or t
gagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccnccccccccaccacgcgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaac

SEQ ID NO: 70054 - DNA, 396 bp, Homo sapiens
aagccttcagacgtgcctcccaccatggctgtgaagttcctgggggcaggcacagcagcctgttttgctgacctcgttacctttccactggacacagccaaggtccgcctgcaggtaggtgccctttggccaagggtcattgatcacatggaaggaggggctagttctctcccatatcccccatgacgtgtgcccacatgcccttcctcagaaccctgacaaagactctcactccactgcttaggacccttccttgcctcctcccatcaccatccaccaggacaaaaaaatctaaattctttgcatgatgtgacagggccctttatgggctaggccctactttgtaaagcatgcagtgtgaggtaaaagtaaggaattaactgtgtgaccttgggc

SEQ ID NO: 70055 - DNA, 1422 bp, Homo sapiens
gagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaaggggtgagcctcctcctgcctccagcactccctcccagagaacaggggcttctttcttttcgaatgtggctaccgtgggtcaacctgggatgtagcggtgaagagtacagatgtaaatgccacaaagaagaagtttaaaaaaccatgcaagtaaaagaaaaaaagtgaaccatacctgatggggagggttagggaagcctgactgagaacaaacactccaggaataggtaaaagtactgcctgtctccagaggaagttagcaatcctgagacctcctggacctcctgccatggccattgagcaccacactgaccatggccagtgccttcctcactgtctccacacgctccacgttttcttgcacttactgctccctctgcgtggaatgcctcatcat

SEQ ID NO: 70056 - DNA, 5388 bp, Homo sapiens
  misc_feature (3)..(3): n is a, c, g, or t
  misc_feature (6)..(6): n is a, c, g, or t
  misc_feature (10)..(11): n is a, c, g, or t
  misc_feature (1917)..(1919): n is a, c, g, or t
  misc_feature (2343)..(2343): n is a, c, g, or t
  misc_feature (3360)..(3360): n is a, c, g, or t
  misc_feature (3475)..(3475): n is a, c, g, or t
  misc_feature (3491)..(3491): n is a, c, g, or t
  misc_feature (3505)..(3505): n is a, c, g, or t
  misc_feature (3532)..(3532): n is a, c, g, or t
  misc_feature (3626)..(3626): n is a, c, g, or t
  misc_feature (4707)..(4707): n is a, c, g, or t
  misc_feature (4733)..(4733): n is a, c, g, or t
ccnagngtcnnctgagaaggagttatctgtgttctctttcccatactgttttaccagtaaagatgatgatgagagaggtggtggtgatggtgttgagagtgatggggttggtggaggtgatgggagttgtactagttttctaggactgttacaataaagtagcacaaaccaggtggcttaaaacaatagaagtgtattctctcataggacctgaggctacatgtttgaaatcaaggtgttgggatgtacctctccctctgaaggctctagggaataattctttcttgcttcttttagattctagtggttgctggcaatccttggcattccttggcttgtagatttatccctccaatctccacctccttcttcacatagtcttctcatttgtgcatctatgtttctatgttcaaatttctttcttttttaaaacacactggccattttgggtttaaggcccattctactccagtctgaccttattttcattgcatctgcaaaggccccattttcaaataagatcacattcacaggttctgggtggccatgaattcttggggggatgttgttcaacccagaacatgagtggtggtaatggagatgggatggtggtattaacgggtatggtagtctgtggtgagggtgttggtgatattgatggtagtgatgatgtgggggtatccaagggttccatctcacatgatatgtactcagttgtagcaaaaatacttattgtacattgatccaaaattggctgcaaacctgtgactggttcttggcacatgcatcactacagagtaacaacaacataaaaggcctattgatgatgtcttaagggctctttgagaagtaaggggaggcagaaagcagttgtatcctcatgacaccgaggcagatgtttccgtctttaggaaggaagacagcatttctctgtacaaagcactttcagtttttacagagcaataatatttaaatgtaagacattcaacttgtaatcaaaatgggaaatagataataagacctttaaaggaaatatgcgtgatgcttttgtagtccatgttcaggatcatcttcctcttatttcttataagaaattttacaaggtctgtcctcatgtcattcagtgggcctgaaattgtatctgtttttccccttgctctaaaagttatattgaaggaatgattttgcactattgcacactaaaaaagcccctactcagaaattttaaaaacatctaaactcatattcagatatagtggagtaaatgaataattgtttcagccagagggttttctcaattagcattttaaggtcaaaatttaccctagaatcctgtagaatcagtggctgtgagtcacctactctttcctttcacataatctatttcttgctgtccacctactaggcaccaagtgaaataataccctttttatgtttctcagctctagcttgcagagaagagtaaagagaaataactactcagggcaggaagatatttgcaagaaggtagcaaacccccaaatccctttgacggtgggaacatcaaactgagcccttgaagactagagttctgggtactcaataatgttcaaagtaaaaatacttcagcaaattggatcaacactaatttataaactaaattaaacaacatgcattaaatgtaatctatgggaagccacaaaatattttgctttgcatattttttaaccttagtgataacaattcttagaccaaaatagaaatctccagtgttgcctgtttgtcaaggaagccttcttcattatatttcaggtggaactaaggagcacaattattttgataaacttcttttttactttttcattttctagagatagtgtcttgatctcttatgcaggctggagtgcagtggcgcgatcatagctcactgtatcctcnnnctcctgggctcaagtgacccttccacctatgtctgtctcctgagtagctgggactacagatgcatgccaccatgcccagctaatttttattttattttattttatagagaaagaatcttgcaatgttgcccaggcagatcttgaactcctagcctcaatcatcctcctacctcagcctcccaaagctttgtgattgcaggtatgagccactgtgccaggcctctttcttacaactttagaatttttccataagatttctcctgtaggtaaagccaggttattcagtggaacttatccttggaatatatgtaaatttgtgccagcagatttttttgtcttttttatttggttgccaatgttatgatagccatttctttctcatcagtttggttcatgctgaatgccttgtgttggtgaaccttantgctatgtctttattagcaaagcctcagaggtatttcggcatttggccaaatatttgcaaaatgtgccagttagtcaagtggagaattcatttatttttgggcaaataatgggtttttaaaatgggattttcaggtaaagtgctactacatagtgaaagcctgctatggtgcaaagcctgctatggtgcaaagcctaggagatcaccaagaaccagcccttcccttccctccatttcctgggaatcacagtgtcccaggaagctctcatctttcattagctattgactgagagagatttttgcagctgcaatggaaatgccctctcgacagtgtcacttgcttttggtttaagcccgaaaaaggtacagcaggtcaagtcccatttgctgctgtttgactggagtgtgggcttgtgtgtgtcttcaccctctagcacagacttgttttttttttttttttttttttttttgatgagactacaaggaagaacacttttccttcactgcatgtattttactgttattattgttgaaaccattccttccacctccaacctttccccgttaccacacacacacacacacaccccaaacccgaaaccaaccacaacagcaaaaaacccaaattatataaagggcaaaggtaatgcagttaatctctgaattactttggattcctaacaaagaaagaacctaaacaagaacagcatctgtttaaagtaaaagaatgttttcttacaaaaaatattgttattgcttattttagaattgccattatgcttctgaaacgtactatgagagtaataaatgttaattaccagagattagaaagtgcaggcaaggagaaagataaaaaaagtctccaaaattatactcaccagaaaaaaacaatcaccgttagaaatctcagggtaatgctttccagatacttctttttctttttccttacttttcacatttttttcttttactttttgtattttattttatgctttggatggggatgtaggtatatgngagtgtatttgagtgaacacaagtatgttttttcatataggtcatgatgatgatgatgatgattacaggcagtctttctctgttgctcagactggagttcaggggtgcagtcatngctcaccgtagcctgnaactgctgggctgnagtgatcctcctgcctcagcctcctgngtagctgggaccacaggtgtgtaacaccaaacctggtagatttttaaattttttgtagagatgaggtctccttatgtttcccaggctggtctcnaactcctgggttcaagggattctcttgccgtggcttcccaaagtactgggattacaggcatgagccaccatgcccagcctatacagaatattattttgtatcgattattctaaaacggcttaattctttcatgttctggtgggggagcaggtagcagagtgttataagagagaatatcccagaataagtgaccagagaaatcctttttggtgaatgacatttatggtgagatattaaggttgagatctgttgtcatgctaagaatggggagacgaactttgtaggtagcagggatcccagttgacaaggcctttgggtggaaggagagcttggctcactcatgcatctgaaagaaccagggggctgaagcacacaggaaactggagagacaagatagaaggtgggcagggatcagatcatccaggcatcttcaaggccatgcttgtttaacttaatgtattgtgactgtctttctgtggtcaacattctaaaagcggtagattttggtgttaagagcctggccactggagtcaaataaatccattgtgtaaacttagacaagctaattaatgtcccctagttttaatttccaaatctttaaagggagatgattgtaggcaatgtctgaagggaccattggggaaaaaaagtcagattatacgtataaaacaatgaagaggctggcaccacttttaatcagttttatggttgaatttattcaacactcattgatggagtaaccaagggcttggtcaagaaaggttatttagcagaagctataatggagcttcaaagagcagagcagtgaaacttgtacttctcctcctcaccacctttggaataatgagcccaggtgctccattgaccagcgtcctcatgcagagccaagtgctattactgtctttttaagttcttaagggcagaaccgtggcttttcttacttgttcttacccagcaccatactctcactcaggacttttttcttttttttttttctttgagacagagtctcactctgctttccaggctggagtgcagtggtgtgttctcggctcactgcaacctctgcctcccgggttcnagtgattctcctgcctcagcctcccnagtagctgggattacaagcacgcaccatcaggcccagctaatttttgtatttttggtagaggtggggtttcaccatgttggccaggctggtctcgaactcgtggcctcaggtgatctgcccacctcagcctcccaaagtgctgggattacaggcatgagccaccgctcccagccagcacttttgaagtagagatggttggtgaatccacgtggaatgtctgataaataacgaaagccaccgtgaatcacagccttttctttccagaagggagatcacacttttactccagtgcagactttatgtatatagaaaaattgaaacatactttaaaagatgtttaaaatatatttcagcttttaaaaaggaggttgaaaatctgtaaaattgtatgattccattaaaaacatggcatacatccagagctcttgtggcacttgtatcaagcggtacagctatgcacactctctaaggcgggcagctgtaagggctgtcctctgcttctggcatgccacattggctaaatatatcgaccatcacctctgcatgcacagcagtaattattgacgtattcctgatggttttctctggctgtgaaattatgggaaattaaatatagtttatatttttacaatgaacacgtattacctttataat

SEQ ID NO: 70057 - DNA, 453 bp, Homo sapiens
tcacagagttaaaattttcttttgattgagcagtttggaaactctctttttgtaggatctgcaagtggacatttgcagtgctttgagttcaatggtggaaaaggaaatatcttcacataagaactagacagaagaattctgagaaacttctttgtgatgtgtgcgttcatctcacagagttgaacttttctttttattgagccgtttgaaaacactgtttttgtagaatctgcaagtggacatttgtagcactttggagccaatggtagaaaaggaaatatcttgacgcaaaatctacacagaagcaatctgggaaacttctttgtgatgtgcgcgctcatctcacaaagttaaacctttcttttgattgagcagttttgaaactctctttttgtagattctgcaagtgaacgtttggagcggtttgagacctacggtggaaaaggaaatata

SEQ ID NO: 70058 - DNA, 318 bp, Homo sapiens
aatcagaagacttgatattgttaagatgtcaattttctcaaactaatctatagattctacagatttgatagatctatagatccaaggctctctcactcaaaatctcagcatgaattttttaaaaaacttcataaactgattctaaaatttatatgcaaaagcaaagaaactaacaattttggaaaaaagaacaaacctggaggactcatatttcaagattactattaaccagtaatcaagactgcattgctgggcgaggcgcagtggctaatgcctgtaattccaacactttgggaggccgaggcaggtggatcatgt

SEQ ID NO: 70059 - DNA, 998 bp, Homo sapiens
acactcaaagggaatgttcatcgagcatttaggattaccgatgttcagatttgggatactcaactggtaaatataagccaaatatttcaatatttgaaatccaaaacacttgtcccaaggatttcagataacgggtactcaaccaataatgacacatgattctatttttttttaaacaagggtagggaagacagattaaaccagtaaaattaaaatctcagggacttttaaagtcaatgttttgtaaaaataagactggactagataatgttggaccattttattgttttatcatttttatggattgtagaagcttaacacaaagttaaaatgagaatgaaatgacaggattttgtttcaagaaggaaggtataacagctgccatttattatctactgtgttccaggtgtgatgtggttgatagataatgtcatcagtgaatgttgaacattactatttatttaaaattatcgtggtttgaacaaaacaggacaagcacagcgcacagttgtcttgagttttcctcttgattgccacattgtaataatatataaggctcaaacttacagatctttttctaatatatatggagtttctattattttgttattccttgccaaaaaaaaaaatcactagttaattctagtactgattacaaaagaatgacttaaacttctaaattggccattcacatgtactcatattattattgtgagttactttgctttaggaggaaaaaaaaggggattgatttcaagtttgaattaagtttgacaatgttgggaagagtcattagtcaggcccttatattgctagggctagttgagaacccaaaagttaaaaactttggaaatagcaaagacatttcactccaaagtaaaatgcaagtttaatttttttggctgtacagggtttctggcttcatctttgaatgccaatatccttcaaccttttatcctcaagtatctatgatactcattgctgactcctgaaagcag

SEQ ID NO: 70060 - DNA, 605 bp, Homo sapiens
aaaatcttgaatgaactgtcttgggcaaacaaaggaattctagttttttatctgccagcttttaaaaatttcccatctttgaaaggaaagtgttacattaatcacaaactcccatggtcaaggtgatagcaaaacaacactgtattctggttggaaccttggaacattcagaccttggagagaacaagcaaaacattttcataattatgatgtcatgtgggttgaaagcagagtcttgatttgagttcctctgctgcccataaacagctgggtgggaatttgggtcaatcccttcacttctctatagctccctttcctcatccccaaaatgagatgcttgtttgatttcagagtttcctgctaggtctacaattctgtgattagcatctctgctctctggaatattcttttatgtccggtgacttaaatcagattatcaaatatttattgaacacctgctatgtgtccagaaactgaaattatttgaaaaattggatctgtgggggaaagaaggggctgagaagggacaaatactagtaaagagaaatggatggagctcaacaactaagaatttttgaactctaataaatgtttctactttctcg

SEQ ID NO: 70061 - DNA, 173 bp, Homo sapiens
ttgcatccaatgttgttttagatattaagtagtataatgtgggattataccacatattgcattactcaaatcttaaggaaaaaaaggttgctatctaaaatgtgaatataagataagtatgtttttcttgggggagaggataaacctgtaaggtcagcattacattgaatcta

SEQ ID NO: 70062 - DNA, 679 bp, Homo sapiens
gctttggacattcatagttacttgggacaacagttttagcagggctctctttctcctttcctgatctctctgttaagctgcctggctcatttgatatcacatccaaattatcagctgattgctctattgttttggacaatgccctgaagcataccaaaatgtgtctggaattggtgggttcttggtcttactgactttaagaatgaagttgcggacttttgcgtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgc

SEQ ID NO: 70063 - DNA, 853 bp, Homo sapiens
gctttggacattcatagttacttgggacaacagttttagcagggctctctttctcctttcctgatctctctgttaagctgcctggctcatttgatatcacatccaaattatcagctgattgctctattgttttggacaatgccctgaagcataccaaaatgtgtctggaattggtgggttcttggtcttactgactttaagaatgaagttgcggacttttgcggtgatccaccctaccacatattgtctcctaatggccgtccagtttatcctggagcccttgcatgacacaggcctatcgaagcataggagatgccaatattttacctcttgggtactttctgtgtagaagattcataacaagaacaatacttattctgcaattctttatataaagtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgc

SEQ ID NO: 70064 - DNA, 1013 bp, Homo sapiens
gctttggacattcatagttacttgggacaacagttttagcagggctctctttctcctttcctgatctctctgttaagctgcctggctcatttgatatcacatccaaattatcagctgattgctctattgttttggacaatgccctgaagcataccaaaatgtgtctggaattggtgggttcttggtcttactgactttaagaatgaagttgcggacttttgcggtgatccaccctaccacatattgtctcctaatggccgtccagtttatcctggagcccttgcatgacacaggcctatcgaagcataggagatgccaatattttacctcttgggtactttctgtgtagaagattcataacaagaacaatacttattctgcaattctttatataaagctaaaagaaaatgcattctgccaacaactaatgagcttggaagagaactccaaaccccagaagaggcctgtcacattggctaacaccttgatttccacccactgagaccttgagcagagacttcagttacaccccacccagacttctgacctgcaaaacttaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgc

SEQ ID NO: 70065 - DNA, 1029 bp, Homo sapiens
cttttctgctgctaccaggagacctgggagatttaatcttaacttttctaaatgtctctctcttcccctctttactcatctgtcaaggttaccttctttctgacacttcattgatgaccttctcccagccccactccagacaaaattagccactcctttctctgtactgtcttatagagtacaccttctgctgtagcaaatagcatattacattttggttattcatgtacatgtcattttcaaatcgagctattcaaaggcaggaactgtcatcttaaaaccataatgtattgagtattttacatatattatctcattcagtttttacaataaacctaagagctcaggggggttaaatatcatgctccactgaaatgtaattactcagcaaaaatagggcttgaaactaggtcaggatttatatctatacctagcacagtgcttggcatcaggtgtgtagagggtcaataaatgcccaacaagtaagtaattaaatgtacaaactgtatgttacaagaaagtcttttggccatcagatgaaaacaagtcctttcagttactccccacagctgtgagtatgctgcggactttaattcaaaccagaccttaatacctaggagaagaaggatatatcacaaagccgaattaccgggaacaatgctgtaaccacctcagttaaggtcatctaccgagcttggccttcccaataatgttgttgacatcagaaaaatcatttaaagattcaatttaaaatgttaatactgcagtgtcagaaacatacaaacatgaaacaagaaaaaaagccttccttccattgtgtgaaatgagctttgtcatgccctgtgttcagatggaagattttcttttgctaaaatattaagacctacttaatgaactttgacaaagcaatgcacttttccaagtttgcatagtttgcgtggttatctgtttttggtaccactatctcctgtgttcctgaaggagtttcttgccatgatttgaatgaataaagatcttttcgaactaaaa

SEQ ID NO: 70066 - DNA, 1108 bp, Homo sapiens
ttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggc

SEQ ID NO: 70067 - DNA, 1293 bp, Homo sapiens
ttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaa

SEQ ID NO: 70068 - DNA, 1246 bp, Homo sapiens
ttgacttctgcaaaggtgtgatcggaagatacatgataaccttggccgatatgataatcatatgcaaagtatgaaaaacacttgtttttcctactatgtagagactagatggaaactttggatcgtatgttcccccccctcaaactgacccacttcttatttggagagttggttcttctgaagtctgtattctcttgtaaaccatctctgtaagtaaatttctatattgtcttggcctcattttgatactgcttattggctctccccttacttggctttctctgatccataacatcaagggtacagctgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggc

SEQ ID NO: 70069 - DNA, 415 bp, Homo sapiens
agttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatc

SEQ ID NO: 70070 - DNA, 968 bp, Homo sapiens
taagggctatcgtcgacccacgccgtcgaggggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggc

SEQ ID NO: 70071 - DNA, 1053 bp, Homo sapiens
aaaaaaaaggggggatgtcctttttctttttttaagggccagggggttggtcaaattccccatcgattaatttttttcttctgtggggatttttttcaactttttaacaaggcccaactaattgcccatgggacaatctacttttccccccaatttatcgttttgagtagggaaaggttcattttttttcattccccggctttaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgca

SEQ ID NO: 70072 - DNA, 1216 bp, Homo sapiens
aaaaaaaaggggggatgtcctttttctttttttaagggccagggggttggtcaaattccccatcgattaatttttttcttctgtggggatttttttcaactttttaacaaggcccaactaattgcccatgggacaatctacttttccccccaatttatcgttttgagtagggaaaggttcattttttttcattccccggctttaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgcaaaaaaaaaaaaaaaaaaacaccagaatcgacaccaaaagcggaaaaacatagaacatgcaaacaaaacaaagggggggggtaaacaacagggggagaacacccctttaagggggcacaagtaacaaagggggaagggagaattgtaaacgcttgggagaccca

SEQ ID NO: 70073 - DNA, 822 bp, Homo sapiens
  misc_feature (765)..(765): n is a, c, g, or t
  misc_feature (787)..(787): n is a, c, g, or t
aaaaaaaaggggggatgtcctttttctttttttaagggccagggggttggtcaaattccccatcgattaatttttttcttctgtggggatttttttcaactttttaacaaggcccaactaattgcccatgggacaatctacttttccccccaatttatcgttttgagtagggaaaggttcattttttttcattccccggctttaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaataaaaccttgtcccagnccgcgccaaaaagccccccggnggcagttttttttttttggggcccgtcctaaaaaa

SEQ ID NO: 70074 - DNA, 235 bp, Homo sapiens
ggaggcagaagttgcagtgagccaagatcacaccattgcactccaacctgggcaacaagagcgaaattccacctcaaaaaaaaaaaggtaaagattgtccaactggataaaaaggcaagacccaagtatatgctgtttataagaaaaacattttaaatataaagataccaatgggttaaatacaaaagggtagaaaagttatagcatgcaaatattaactgtaaaaatctggttt

SEQ ID NO: 70075 - DNA, 876 bp, Homo sapiens
caagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactggccctcagagccgatgatgaagcaaccacacctcctgccagcgaagctcctgcagccacagccgcagccgcaggccctgcactacgcgctggccaacgtgcagcaggtgcagatccacagaatcggagaagacggacaggtgcaagtagtacgtaccctctccacctcgcac

SEQ ID NO: 70076 - DNA, 796 bp, Homo sapiens
cgttgcccagggtggcatgactgtagccagccctgggccttggagactctggcagagcgtggtgtccctcctaggtcccggccccttgtgggaggtattcaggtttctacctttccacaggggaggacgtgctgggggaggggagactctggcagcctccctttggttcaacttcagggtcagaagagattgtttgggaagctgctgagcttccaagcaggagtaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactggccctcagagccgatgatgaagcaaccacacctcctgccagcgaagctcctgcagccacagccgcagccgcaggccctgcactacgcgctggccaacgtgcagcaggtgcagatccacagaatcggagaagacggacaggtgcaagtagtacgtaccctctccacctcgcac

SEQ ID NO: 70077 - DNA, 434 bp, Homo sapiens
tctcaggccctaggccaggcctcgttcccatcagataaagcctggggcggccggacgcagtgcaagcaatcgtgcctgactcacaggaagggaggaaaacaggaattcacgcagaagctagtcctccggaggctgagagcaaacggctgcactaggaacccagcagtcagaccggcccccaccctggagtgaacacatcgccactgccaggcatcgcagggatcgtggctgagcaaatgcagccgatgaaatggaagagcaaggggtgaagaaatgagtgaggtgcccacgcagccctcataatgccggggccatcggagagaagaccgggatgagtttttaggtggctgcttcctttggcccggaagcgcggcccaccctgcctgacttccagcactccgttcctcggcttctccatgaaaaggagaacgtgt

SEQ ID NO: 70078 - DNA, 1321 bp, Homo sapiens
ctggctgggaccgtgtgaaagcagctctctgctgcctctcatccagcccgctgtgtccttccacagcactcatctcaatttgtggttatttgacttttctcctgtccctctgggccgtccgcccccttcgttagaatgtaaactgtgtggagtgcaggcctcgcctgtgttactgtgccctcatctcaagctcagcaccgcgtcctgccctgggggcccccatgaacatgtgccgaatgaacgagcggaggaatgggggttggggcatttttattagttttccattcgcccaatcatttctaatgtggatcattttctttcaaatgataagagcgatgtttacttttctatgtttgaaaataagataaaataaaacaaaagacgcctgttgttttctcgggcagggatctgaagggagccgagctccttctgcagaagggcgctgagaagggagctggaaggaaaagaaggaaacattccttcctcaactggaggaagacacgcggccacacacagaaccagcggccccaggaccgtcaccctgcgtgcccgggcctgtccctcctgaccccaggattatagtggcgaggcagggtgttagccaagcggattgagccaggacacaacaccgcggagccctgcaggcgagtcctccggaggctgagagcaaacggctgcactaggaacccagcagtcagaccggcccccaccctggagtgaacacatcgccactgccaggcatcgcagggaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactggccctcagagccgatgatgaagcaaccacacctcctgccagcgaagctcctgcagccacagccgcagccgcaggccctgcactacgcgctggccaacgtgcagcaggtgcagatccacagaatcggagaagacggacaggtgcaagtagtacgtaccctctccacctcgcac

SEQ ID NO: 70079 - DNA, 368 bp, Homo sapiens
ctcaccatctacggcatccggtgtaagtcgggccccatcttgggggactggggtgtgcggggagctgggtcaggacccacatttcactgctgagggtgctggcatcagtagcactggcacggggctgcgtttctccaggcggtttgaaatctcagcccgaggatcagtgctcgaggggatggatgcccggttgaccctgatgtgctcattactcatggcatgcctgtaccaaaatacctcatataccccatcatatatatacctactgtgtacccttagaaggtaaaaaactcctcgcctcctgtctgtaggccactcttgaggaagagagaggaggaggagagccagggccttccctgctgtcctgg

SEQ ID NO: 70080 - DNA, 350 bp, Homo sapiens
tgagatagggtctcactctgtcacccaggcgtgccatggttcgatcatggctcactgtactccagcctgggtgacagaatgagactttaataataataataataataattcagttcaaaagacaggttttaaagctttacggttgtagggaaaatccttttaaattcaatatgtagacttttttgttgttgtaaggagtataaataaaaaagtgcgattaaagacttaaatctaaaaatatcatattagaattatgcaggggaaatataatgaaaaaagttcacagagaaaaaaaggacaatgtaaaatttccaacttttaaagacacacttttcatgtgtatttttaaa

SEQ ID NO: 70081 - DNA, 173 bp, Homo sapiens
ggattacagacaagagccaccgcgaagggcttattttttaaaaaacactggagtcatggcatgtgtgtaaactttaaatatgcaaataactatgtcaaaaaaaaaaacaaaacggagctggatgtatcttgaggtccaaacatcataggtccatgatggaggcaggagtccaa

SEQ ID NO: 70082 - DNA, 415 bp, Homo sapiens
gttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaag

SEQ ID NO: 70083 - DNA, 801 bp, Homo sapiens
cttcctgggaagtaaggcataaccgagacctagcctcccggtagggaagttcatccgtttagtaaacagccccaactacgtgcggaccctcacggggatacgaagaattcaaccagggctggacaagtcagagtgggccaaggacaagtgagcattccagagaatttctacatgaccagctgttcattcttttaagaggatgacattcttcagctcatctggaaaggatacttcctttaagtctgttattcacagtctccaagggcaggtgtagttgggaaagacatttcatatggaaaaacaaacttgatagggtaaaaaaaaaaaaaatgagatgtaatctggaggcccaagtcattttcttaggagaaactcaaatgtgtttggtgttatctaaccttctgcagtttatcagtctgaaacaaatgcattctattctcatttgaaaatgtctgaacagccaccaattttcaaaatcacccatttaactagagactttaaagcccagaatttgcagttacgtatttcagaatgatttagtaattttgtgagcagctcagaggttaagtctacaatgtctgactacggtgcattattgaaaatatcagtagtgtaaggatcccgtagattggtgataactttgctcttgttatttcaacagttaccaccaacagttggtgacttaacaaattaagagcatagttgccatatgctcatatttggcaaatatgtcaaaatggccatatttgccaatttttaagacaataaattcacagaaaatgcattacagaaaataactta

SEQ ID NO: 70084 - DNA, 1837 bp, Homo sapiens
ttgttgatcttttgttttcctcgtattttcgtggtacttttcgctgctgtttgttgattttcgttggatggttttctgtcactggacattttaaagcccttggtagaagattcctcacactattttttagaggctccttttcgttgcttccagtgtaacaagattctcccggctggcgtcttatttaagagattattcggctctttgttggacctttctgttgggattcagcatcttgggtcgttgaaagacgtaattcccaggcccatttagttacaacataagcttacacttgaaaggaacaattccaagaggatctcgtggtgcaacgttgctgtgtaggcaaaaccgttccaccagaagccgataggcagtagtgtttttcagagtactgccacatgttttttgttttcatgccgttgctacattgctcttgtatacggtatttaaatagtcgtagcgtgccatccgccttgaagtaacctctccacgagtaagggctggcacgcatatcttgtagacccctttgagttcctcatgtgaacaggacaacgttcatctaccgtgaaaaattcgtccaaaacctttctacacagtgtcaagagggtttccagaattcaggctctgattatttagtggtgacaaaaaggtagcgtgtctccgatactaattttactgtacttagatacattctatcgcccatattttgcttcacacgacactctataggagtgtgcatagtcgtactcgtctgaactcatcagtatacagttctttgttgactgtttttttttttttattctatttttgtttctttttgtctattttttttctttttttttttttttttttttttttttttttttttttttttttttttttttttttttttttgtagtcagaacaaaggacaacttttatacacgagggcgtcctgaatattcatctaagaaacaatgtctgatcaaacgggacaatccagccagcaatcctgagtcccaccggattatgcttggccagctttctagccttcacattgttaatttattagcaatcttttcaggagaaaggcaattattaaaattatgtggacttctagtaaaattatctcgaagatttacaattatgtataccaataacaaaaaaactacatgttttctgctcccctgcctttgtaggacaagtgagcattccagagaatttctacatgaccagctgttcattcttttaagaggatgacattcttcagctcatctggaaaggatacttcctttaagtctgttattcacagtctccaagggcaggtgtagttgggaaagacatttcatatggaaaaacaaacttgatagggtaaaaaaaaaaaaaatgagatgtaatctggaggcccaagtcattttcttaggagaaactcaaatgtgtttggtgttatctaaccttctgcagtttatcagtctgaaacaaatgcattctattctcatttgaaaatgtctgaacagccaccaattttcaaaatcacccatttaactagagactttaaagcccagaatttgcagttacgtatttcagaatgatttagtaattttgtgagcagctcagaggttaagtctacaatgtctgactacggtgcattattgaaaatatcagtagtgtaaggatcccgtagattggtgataactttgctcttgttatttcaacagttaccaccaacagttggtgacttaacaaattaagagcatagttgccatatgctcatatttggcaaatatgtcaaaatggccatatttgccaatttttaagacaataaattcacagaaaatgcattacagaaaataactta

SEQ ID NO: 70085 - DNA, 358 bp, Homo sapiens
gtaagagttacggctgctactgtgcccacgttggaacagatagattagttcatctgctagttgtgtggcaagagcaaagaattcaagaggggaagagaaagtgagaggagcttagagagctaagcaagaatcgaatcctttgtgtgtcatggtaagaaattcgaacttaataccaaggtagtcagaacaaaggacaacttttatacacgagggcgtcctgaatattcatctaagaaacaatgtctgatcaaacgggacaatccagccagcaatcctgagtcccaccggattatgcttggccagctttctagccttcacattgttaatttattagcaatcttttcaggagaaaggcaat

SEQ ID NO: 70086 - DNA, 937 bp, Homo sapiens
gcccacccaccgtgctccttgggcccagcccaagctgggaccacttcaaatgatggggtgcctcctcaccttcatagcctccaagggatgccaggacttgacctttcatttttctacagactaaagggaccctggaattccaggagggagacctgaagatatggagtgggggtgatggaggatgggcccccatctttgggaatctcagatcagggtcgtgttcttcctccttgccctggaggtttgcagagaccccactgggacaggagccactctcggcctggtgacccctgtggcatagagagggtaagtagtgaataatgaagggacaggctccaggaaggccttgctcccctcactctccagcttctcaggacctgcccccggccccagaatctagcctggcccctaacagccttttcagcccaggggcccagccaaatacttcctgtcacagtggctggaccgagaaggtccagggattatctcagcccctccaagtaaagtagaagagggaaggagcagacatcataacaaaaggagtgcaggctagacacccagaaggacttccctcagcacaggttttggctcttagaatgggttttttaaaaaaaggatctttcttaattccaggactcctgagttgggggcagggcagccgattcttgctgcccgctcccggggaacgggcgccctgcaaaagaggtggaaacggtagggtccgtatcccctggccaccaccctctcccttcctctccaagagctactccgcccccgcgtgccgtcctctcctggctggagagccggcgtcctaggtccccgggctgcgggccggcaggggaggagttaactccggaggtaccggctgggctcactgtacctgccgccgccgccgccgccgccggtgggagggacgaggaagcgggagccgcctggg

SEQ ID NO: 70087 - DNA, 932 bp, Homo sapiens
ttcatgtctcgatttcttgtctgtaaaatagagatagtaacatttgtaaaagagggtgatttaatggttaaaaaagcgggaatctgtgtatggtatctagctcagtcctcgcctccaactccgcagctggtaaataacggtcgttttagtgtgatctgataggcgctgcagtggagatggggacaaagggctaagaaaacagaggtctgtgagacagggaagggcaagagggcaaggttcccggtgagaagctctgtccccacacagtgaaggaggaaactaggggaccacaggcagaaactaggagaaaccacaggaggaaactaggggtcttgaatcctggagcaggaacttactgtttctcttagaatatttcctggtcgtttatgtgatatttttctgatcataaaaagtacatatactgtagaaagtgtgcacgtgttttagtctctttcctctatctcctcaccctttccccaggccatttaagttagtattctcattaaagatgtgtaaccggtaccactcgaaattcttccaaaatgtcccctttttttgcgggaggaagtcagcacactttttctcatccaccttatctgtaggtgactcctgctgggatcagaaactttgttttcgtcacactgagcctcttagagctgacctggctcagatcccaaactctgggcccatcatttacacatgaagaccccttgtttctacagttcatatcttgaccttcctaggctgccaatgcacttaacatccaaataattgtatgatatttggatcgttcaaaagactgaaatgcatataggtgtgtgtgttcatgtatgcatacatgttatgcagtataccagtacaatgaaagctggaaatctgtcacccagcctaagttagaatgttcccagtataatttgtcaaaaatgtaatgc

SEQ ID NO: 70088 - DNA, 770 bp, Homo sapiens
caggagatgagcctagcactctgactcgtaggccagcgcaatctccaggacaccatgcggctttgtgatgttttcagataagaggcggaagagggtactggttaagagcccaggttctggcaccagccaacctgcattccaatcccatctccaccacctactaaccacctgatcttgtgtgagttccttaacctccccaaacctgtttccttacctgcacaatgggggtgggagagaacagtcttactccatagagttagagtgatgattaagtgagatgatgaacataaagtactcaaattcatgtactcaaaaaatgtgagtggcaggcacagtgcaggacccacaacagagatcaaggaacacagtcctgctctcacggagcttagactttaggcaaaccatacacagaaaaaagtaaacagataaaatacttacaaagtgtgttaagaatgattaaggtgcagggcgcagtggctcacgcctgtaatcctatcactttgggaggccgggtcaggcagatcacctgaggtcgggagtttgagaccagcctgataaacatggagaaatcccgtctctacaaaaaacaaaattagccccaagcttattgggcatggtggcgcatgccagtaatcccagctactcgggaggctgaggcaggagaattgcttgaacccgggaggcggagactgcagtgagcagaggtcgcaccactgcactccagcctgggcaacaagagcgaaactctgtctcaaaaaaaagaatgatta

SEQ ID NO: 70089 - DNA, 306 bp, Homo sapiens
tttttgtgggataggtggaaaagttggaatttgggcagctggcattgttttacaggaaactgctttttgattttatgttttatcttcgaaattctttataaaaatatcttgtttgtattcttcaagaactctttcttgttctctgcttattgttttaattgtaactctgttctcatttcaaggacatactgtcttctctggggacatttattatggctttttaatatgtattccagggagaatattacatctttttaaaaagtatttctcttcccattgcattgacttttacttctacttctttaa

SEQ ID NO: 70090 - DNA, 3483 bp, Homo sapiens
  misc_feature (1)..(1): n is a, c, g, or t
  misc_feature (4)..(4): n is a, c, g, or t
  misc_feature (9)..(9): n is a, c, g, or t
ngcncgagngctgggtcacagcccgggccgcacagcccgggccgcaccgcccgctccgcgaggaagtgacgactgcgccgtcccgagagcaacaaagttagagtctgcgggccgcactcgcctgcgccccgcacccctccgagcagcccggggatccagcacgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaa

SEQ ID NO: 70091 - DNA, 461 bp, Homo sapiens
cagccaggcgagcaggactagctggggctggtgaaccccccggccgggtcagaatctgtgctacagcagtgagacagagctctaggctcactgcccttgttcttgttccccatagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaa

SEQ ID NO: 70092 - DNA, 187 bp, Homo sapiens
ccgggttttgctgtgcagtgtcctcctgtccattcccatccctgattctgggtcagtggactcagactggatggttgctgagagccttctccagcagtgctgcctcccttggggccatggactctcttaagaggacctgaggtctgttttctgggcagccccccccctgtgatctcaccaccccagt

SEQ ID NO: 70093 - DNA, 3954 bp, Homo sapiens
  misc_feature (2562)..(2562): n is a, c, g, or t
gtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcagaaaaagtttgctgacttctgccctagaggagatgataanaagggcttttggacctgctccttttttcaggcttgccttggtgggtgtggtaggcagactaagttccaaaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaa

SEQ ID NO: 70094 - DNA, 5113 bp, Homo sapiens
gtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctggtgagctgggctctgtttcagggcaaatgagggccaggagctgcctgtgtgactttggggctccctctgccagtgaccaatccctcttaaaaagcagtcaggtcaatgctactgagtagcctcagagagaatttcctaaacaatacaagaaagagaaagataggtctcttttcccttttggttctaagcatcctttcctcacttcagggtagggtggccaagctctggggtctcaatccagaaggaggcctaagtgggcatcagacttaaaataggcaggaggaagatgcggaggagggtggcaagtagaggtgagccattccccagaggaagatgcagggggagggcaccctggggtgaaggccactgagagccagcaagtgcctgcggagctgacctgggggcctctgcccacttcctttgacccagagttgccttccagtaactcagctgttcaagcccacattccctagatttatcttgtcctctctccatattcttctggaaaagcagatgctctgctaatccaaggaattgcatctttccagccctgtctcacaaaatctgggctgtggggagagagaattgtgtggactgccaagggaaaagagtttttaaaaagagcatgccctttcctcttgggattgtagattgtattgggaacagccctggggactagacaaagtgctgatgatgaattcccctacaagggccctgttgtgaggagtcctttgctgtgttttagtaacacgctattccctgattgggcaatactgacgggaagtacacgcccgtgaaattcacggaggcgcccctaatgcctaatgaaatgagcagacctttagtcagtcaaacaaagggtcagagagaattgacagtaaatgtgtaaatggcctaattaatacatgtgtggtagcagagtcaggaggaagacttaggcctttcgcttcctcctcaggttttccagggctttcttgtgagtttcccttgagttcctcccccgacaggggacactgtgacatttctgtatgctcacttctcagccactgctccctggagagaaatgaaattgtttgcctggattaatgaaaagcgtctgtgttgccaggtcagggctggctttggatgtagatggtgcccagaccttttccctcaacttttcagtttgaaaaatttcaaacttagaggaaaatggaaagaacagtagaatgaacacccatccaccccggacttagatttagcaatcgttaacattggctatatttgctttctctttctctatgtctaaacatagacacacacatatacagctctctcttgttctctgattcagctaatcattaaaagtaagtcacagtcatcctgtcacatgactaaaacctttcagcacgtatctcctaaaaaccaagatattctacaaaaccacagtaccattagcacgcccacgaaatttaacctgataaaataattcaggccaggcgaggtagctcacgcctgtgattccagcactttgggaggcagaggcagacggatcactcctgaggccaggagtttgagaccaggctggccaacatggcaaaaccccatgtctactaaaaatatttaaaaaaaactagctggttgtggtggcacacacctgtaatcccagctactcaggaagctgaggcacgagaattatttgaacctgggaggcggaggttgcagtgagccaaaatcgcgtcactgcactccagcctgagtgacagagcgagactctgtctccaaa

SEQ ID NO: 70095 - DNA, 179 bp, Homo sapiens
cacaagccatcagtcatcgtcacccgcaggcggtccacccgaatccccgggacagatgctcaagctcaggtatgagaggcgccccttctaaacacctccagcgcgtgagtgctcagggggcccaggaccctatggggaaaggagaacatggcaatgtaggaaggtatcagggaacctgt

SEQ ID NO: 70096 - DNA, 452 bp, Homo sapiens
tcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtaagtggggctgcctggccggcggccgaggcctgcacgcggcggggccggcgaggggaccccaggcggcgcgcgagctgtggctgctcgcacggcgggttgcagctctgcaggcgcggcccggagag

SEQ ID NO: 70097 - DNA, 358 bp, Homo sapiens
ctgggcagccccccccctgtgatctcaccaccccagtggaccccttatctctcagcagttaagggggcaagagtaagtgtccaccctactcgggattttatcagggcctagaatgctccgtccaccaccgacacccctgtcagtgccctgacccttccctcacttcccctccaggaaacgctgaataagctgctgctgaagaagcccctgcggccccacaaccatccgctggcaacttatcactacacaggtgggcctggctgcggtgggcatggtgcctggagcctcaagaggtctccagcatccatggggccctgctcagtgctgagtcacagccctgggtgggggcgggaggagg

SEQ ID NO: 70098 - DNA, 3844 bp, Homo sapiens
gtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaa

SEQ ID NO: 70099 - DNA, 2982 bp, Homo sapiens
tggagttttctgacccttccttagccaccaagcgagcacgagaagacagtgggatggtacccctcatcatcccagtgtctgtgcctgtgcgacctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaa

SEQ ID NO: 70100 - DNA, 3830 bp, Homo sapiens
gtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcggaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaaggtgactccttttccaacctcagctgcatagagcctgggctgggtctgggaccaggcctgagctgggagcccgagcccgagctctccaggagcctgcagagggcaggttgaggaagacagtgtccctgacagccgcaaggagccctggaccgctgggttctcctctctatactgctggtgtcatagtaataatacattgtgttgatacacagggtaattttcccacaagattcacaccagcatcatcttcctatctccgcttagcagacctctaacactgtttctcaaacctcagtcattcttgtatcacctttttgatttctgccatatctg

SEQ ID NO: 70101 - DNA, 365 bp, Homo sapiens
gaaatgtggtatattctatatgtctatgatgtagatctttagaaaacacttcttatgttttgaaattcagccaagtaagcatggtggtattaagcacatgatttcaattttgaaggtcagtttaatatagataaaagacaacaggcacctaaaaccggatgccatttgacccagccaccctacttcactggggaggaagttttacacatgggtgtgtgctcagaaggggttatgctaatctttgtcatagtgttatttgtaatggtgaaaattttgacttaacctgggtttttaacacaagaataaattaagttatatattgtattagtctgttgtcacgctgctaataaagacatattcaagtc

SEQ ID NO: 70102 - DNA, 353 bp, Homo sapiens
aaatacgaaagcaggggctgtcagttgcctccattgaccgtcagctccttgaggacaagggaccctttttacccagagcaggctgcataaaataaattctaaggaatatttattgggtggaactgaattaaattaggaggctgggcagagaaagaggaggctgagccgttctgagcctgcatcctccaaaagatgagaatagtaatacctgggctgagaggaccgggtatgggatggcttataaccatctgggcagggcctccctgccaccctcagaattattgtcatctctctgtcccagctctactgttatttttatttttattattttgagacagagtctcgctttgtca

SEQ ID NO: 70103 - DNA, 139 bp, Homo sapiens
gaaagaaagaaagaaagaaagaaactggctctcattggctcccatgcaggtgcaagctttgctctcagccagcccacaccccaatggccactaaaaggcgagatgtggtgaccgcaggtggatgtcttgtcagctgagg

SEQ ID NO: 70104 - DNA, 222 bp, Homo sapiens
catgttattcctcatgaggcggaggttgcagtgagccgagattccgccactgtactccagcctgggcaacagagcgagactccatctcagaaaacaaagaagttccaagtacaatacaaagaaattccctcccaatttgagagtaagttgccgatataccctatgaccgccccccccccgccaatacttcagtgggtatttcctatgaacaacgacattctc

SEQ ID NO: 70105 - DNA, 478 bp, Homo sapiens
ccaagattgcaccactgccctccggcctgggccgcagagtaactgagactttgtctccaaaaaccaacaaaccaacaaaagttctctgctctctatctggctcacttccccactgtcctagatagccatctttgccctgtgcgcctgtggctgagctgaatcctgagcatccagtgggttctgctaggtgacttatctgcctgcatcattagacctgagctctttcaatgtaggggctgtatctttctgtttgttaaatgaagacttgtcctcaagaacttacaatacaatcagtatgcaaatgagtataacagacagagggttttacacttaggtctgtgttttccatatgcagtgttcttcaaaagtcttggtgcaggttgaagctttcataacttcagaagtctaaatgctacaaacttcaccaaaaaaatttcaaagtctatttaaattttgcataatgaatgtttccctctta

SEQ ID NO: 70106 - DNA, 385 bp, Homo sapiens
tatgtggaagctaagaaagtgccctttgagaatccctggtcacttctgaaattgtaattcctaggaagttactggagctaagacttctttttagagggaaacagaaaaaaaataataggactatgaagatcaggtcttgatcctttcagagttgctaatgctaatgtcactgttcttcttttttttttttttttttccttccaaagatagaatgacactagttagaaaaataaaagtctgttatttaacatttcagattatgcctccaaatcctacagaagtataacaaccatagaacagacaaacaccaacagcatcaacaacagagaaactcagtccaggaggatatgaaaccctttgtaataaagaaagcaacatccatgaa

SEQ ID NO: 70107 - DNA, 387 bp, Homo sapiens
gattctgtgcattcatcttctcgcagggaccatttcagtagagccttttaagacacatgttttggaatacagtcaaatgcgtgctgctgtatgaccagcctatttgaactacttaagcatcaactaattaatctgcaagtgaagaatacttccagcattactctataattagacaatctcaggaggaaacaagaggatttcaaaggggagtcagatggtttcgcagaccgctacatcatttattttttcatcactcagattatgcctccaaatcctacagaagtataacaaccatagaacagacaaacaccaacagcatcaacaacagagaaactcagtccaggaggatatgaaaccctttgtaataaagaaagcaacatccatgaa

SEQ ID NO: 70108 - DNA, 323 bp, Homo sapiens
aagttgcagactgcgctcagcaagacctcacaacatggaggaaaattaaagagataagtggtccatggagtatccccttaccccaccataaattggcataattttgtgcacaatccagggagaagaaaaagaagaccagaagcttgcaaaccattcgagagaaggaagggagctttgtcatgttgccatctgagattatgcctccaaatcctacagaagtataacaaccatagaacagacaaacaccaacagcatcaacaacagagaaactcagtccaggaggatatgaaaccctttgtaataaagaaagcaacatccatgaa

SEQ ID NO: 70109 - DNA, 620 bp, Homo sapiens
agcaaaggaatgacaggttttgtcaagctgcaggtgactataagatacagacagctgacaattgtggactcctcaggcgtggtgaaagattgagctactatcattagggttggctggctaggaccccggcaggcacctggggatagtagtgctgggaagttctggggagttgcacttctgaatgctggcatgacactgcctcaagacatctctctatccaaatggaaaaaacaaccacatcctttgtcagctaaggagagttagcaaactgtttttattaaatactgatgtctggccgggcacggtggctcacgcctgtcatgctagcactttgggaggccgaggcgggtggatcacttgaggccagtagttcaagaccagcctggccaacatggtgaaaccccatctctactaaaaatacaaaattagccgggcgtggtggcgggcgcttgtaatcccagctacccgggagactgagttaggagaatcgcgtgaacccaggaggcggaggttgcagtgagccgagatcgcgccactgcactccagcctgggtgacggagtgggactctgtctctaaatacataaataaataaataaataaataaataaataaataaata

SEQ ID NO: 70110 - DNA, 430 bp, Homo sapiens
tatttacttatttgagatgtgggggctgtgttgcctaggctgtctcaaactcctgggttcaagtgattctcctgcctcagcgtcccaaatagctgggactacaggcacacaccattgcacctggcctttgatcattattttaatgcctttgtagtattaaattgaatagtactgtagtttgtttagccagtctaccactgatggtcatttagattatttttccattttatttgtctgtctgtctgtctgtctgtctatctatctatctatctatctatctatctatctatctatctaatctttagaggcgctgtcacccaggctggtcttgatctcttggcctcaagtgaacctgggcctccaaagtgctgggattataggcgtgagccactgagcttggtcagttatatttattttttctaatggttta

SEQ ID NO: 70111 - DNA, 772 bp, Homo sapiens
agaggtcttccatggtcttccatcagatagggaggaagctaaaggcgagcatcacgtccatcattttccctgcgcgtggagttgtgaggggtaggttttccttccctaaacctgagtatatagaggatttagggattttccctcaagaactaaacatttcctcacgggaggaaaacatatcccccattggactccttaggacaaatcttgcagattatcatacaaaaatgaacagcctgaagtctaaactgactcactaaggggtatttccatccttgggttctggcttaatactttctcccctccccaactactcactgcccagcctggcctctccccagactccgcagcagcctcctcgctgcccccttcactttcttattcctgagggtgtagatgagcgggttgagagcaggtgtgaccacggtgtagaagagcgatacgaacttgccccgtgcctggttgtagcgctgcgcgggctgcaggtaggtgtagatggccgagccgtagaacaggcagacggctgtcaggtgggacccacacgtgcccaccgccctcctccggcctccgctgaaccgcatgcaacagacagctcgggccacggcaccgtaggaggccaggatgacggcaaacggcagcagcaggatgaccacgcgggcggcgaacatctggttctcggtagtgtctccgtcgcctccgcaggccagcttgagcaacgccggcagctcacagatgaagtggtccagcaggcggggcgcgcacagcggccgct

SEQ ID NO: 70112 - DNA, 533 bp, Homo sapiens
gataagattggcatggctttatttgtttttttgttttgttttgtttttttggttttttttggcttgactcaggatttaaaaactggaacggtgaaggtgacagcagtcggttggagcgagcatcccccaaagttctacaatgtggccgaggactttgattgcacattgttgtttttttaatagtcattccaaaatatgagatgcgttgttacaggaagtcccttgccatcctaaaagccaccccacttctgtctaaggagaatggcccagtcctctcccaagtccacacaggggaggtgatagcattgctttcgtgtaaattatgtaatgcaaaatttttttaatcttcgccttaatactttcttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaca

SEQ ID NO: 70113 - DNA, 511 bp, Homo sapiens
gaaacaggaaatatgatgcaaacctaccaaaaagaggctgaaaagaaaagctagaagggctgggcaaagaaaagcccgagagtttgagaaagcgaggttgaagaaggcagaataacagtttctactctaacaatggtgggtgagtttacttccactaaagcacaaatgttacaagaaaggggtcccaatccagatcaccacagagggttcttggacctcgtgcaagaaagaattcagggcgagtccatagagtaaagtgaaagcaagtttattaagaaagtaaaggaacaaaagaatggctactccatagacagagcagccccgagggctgctggttgcctatttttatagttatttcttgattatatgctaaacaaggggtggattattcatgcctcccctttttagaccatatagggtaacttcctgatgttgccatggcatttgtaaactgtcgtggagctggtgggagtgcagcagtgaggacaaccagaggtcactttcgttgcta

SEQ ID NO: 70114 - DNA, 229 bp, Homo sapiens
ggagaagcttctagaaggggagcagtccctttgcaacctcgaggacatccacatgagcctggagaaggacgttaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcattagctttctgcaca

SEQ ID NO: 70115 - DNA, 712 bp, Homo sapiens
ccccgcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcattttttttaatgtatttatgtatttatttgattgttttatataagatggtttcttacctttgagcacaaaatttccacggtgaaataaagtcaacattataagctttatcttttgaaactg

SEQ ID NO: 70116 - DNA, 444 bp, Homo sapiens
ccccgcaggctgagggcaggtgggaagcaaacccggacgcatcgcagcagcagcagcagcagcagaagcagcagcagcagcctccgcagtccatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcattttttttaatgtatttatgtatttatttgattgttttatataagatggtttcttacctttgagcacaaaatttccacggtgaaataaagtcaacattataagctttatcttttgaaactg

SEQ ID NO: 70117 - DNA, 137 bp, Homo sapiens
tggtcctctacaccctgcgggcaccacgaagccccaagatggtgcaagggtctggctgctttgggaggaagatggaccggatcagctcctccagtggcctgggctgcaaaggtaagcaccccctgccaccccggccg

SEQ ID NO: 70118 - DNA, 512 bp, Homo sapiens
ccccgcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagcccagatgtcaggtctgctcttggagagatgacgatactcccatgcctggtcaatctaggcataagagcctcgtcacaccctttatccagggttttcacact

SEQ ID NO: 70119 - DNA, 571 bp, Homo sapiens
tcaagcttgattaaagctggcttttgtgacatcccctgattccatgtggtgttggtagttttaggcgattggttgtacagctcccttttccccctcagaggcaatcactcctgcagccatttcctgacatatgccagggaggaactgatgtttctctgtggctggtgacctagtgcacagtaaggtcattcctaaaaagctggctgagggagaatttaactcttcagatcaaatatatttgttccacccctggctctgcctcctgatcaaagtcaggggtgatttcagagaggtggcccttcactcagtcagatgctgtgcgcctgctctctctccacgggcattaaaaacaaggcactcatgtgaaaccatgtcctcatcatggcagccgacctcggtttatcacagagtcgaggcccacatctttgatcctcctcataaaactgtctgagagagttgcacaaacccacggatgtcttttattgtttttctaatcacttttaatgtgttttcccacagtttttgtaggtgttgatgtctcagcctggctgtgtcagcaaaaaaaaaaaga

SEQ ID NO: 70120 - DNA, 527 bp, Homo sapiens
gcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccc

SEQ ID NO: 70121 - DNA, 487 bp, Homo sapiens
aataaaagcatcagcatgacagaacaactttttatcagagatattgtactttgtacaactggggaaggaaggtacatgtagaatcatttttcctacataacatgacaggattcgagtcccaagaaaaagcaaaagttcatggttctcttgtttcttttaacttggtcctgtttcatttcaagccacattaattcacatcatcaatgtatgtgaatgccctccaaatgcctagatctgtgctagatgctggggtgccaagatacaaagaaaagatcattcagactggagaatgaaaagcctcagaaggttatagcaaactactagacctgtgtctgtggcttatgaggatatattagcatttaacctgtcttctcaagaaagcacggtaaagctaaagcataatagtgcgtttatattacggtttaaggagaccggtgtcctgatgaccactcaggcttctctgtccatgaaatccagcaggtttttc

SEQ ID NO: 70122 - DNA, 397 bp, Homo sapiens
catttctggccaggcacggtggctcatgcctgtaatcccagcactttgggaggccgaggcaggcggatcacgaggtcaggagatggtctagaccatcctggctaacacagtgaaaccctgtctctactaaaaatacaaaaaattagctgggcgtggtggcgcgttagtatttccttaaataacaggttacaatagaaagatactgcctggaagttatccttttcattttggttcattttcagtttttgtttatgatttacatagctgtttaattcatttgcttatagtacaatcctgccataaagtattaaagcacaagatacctgttattccttcaacatctgcatttttcaagttttatactctatatccacagtatgtcagcagttcttgactg

SEQ ID NO: 70123 - DNA, 133 bp, Homo sapiens
actcatctcctgcaggtaatcagtttcatttctgggttattcttcctgtatatctttttgcaaaaataagcaaatgaatcatctgcgtatatgtaatgtatatatgtacattcttatttcccctttttcctaa

SEQ ID NO: 70124 - DNA, 550 bp, Homo sapiens
  misc_feature (84)..(84): n is a, c, g, or t
atttcggcacgataaaattcatatcaatatggctgggcgcggtgactcacgcctgtactcccaacactttgggagccaaggcgngcggatcgttgagctcaggagttagagaccaacctgggcaatatggtgaaatgtcatctcccaaaaagcccggccgactattttttatttcaccaaaaagcatgcaagttgtcatgaggactgtagggagaggcccaaagcctttgtaaatctcttctaccaacattttcctcctcaatatagtagtaggtaggcaaggtagggaaagagaatgtcgaggggatttaacttttaatgtttagatcacacacaagtttggttctcttctcaaactttaaaccaagtttattcctacagattgaaaatcaatttagatcttttaattgggggaaagatatcatgtctcttctcaattaaatgaatttgtaattataaagggtttagaatgatatgtgacagtggtaagcactatataaatatatgttaaatataaagtgtgtacgtgtatgcagaactcttgttcatc

SEQ ID NO: 70125 - DNA, 1266 bp, Homo sapiens
agaaaagaacggatactgggacaaagcagctgctctgctagcaaaggaagatctttgtaatagtgagccgtctcactgaggaacattctatagctcctgcttatagttttcttcatatagatgacagctatttattaaatttgattctaactgactccttgactgaactctttgcttttcagttgatattcacactaattccagatttataatcatacattccggaaatcatgatacaggttgagcatcccccagaaccgaagctttctgagtgccaacatgatgcataaagaaagtacgcattggagcatttggatttgggtttttggttttgggatgctggcagtatccaaaggaaatattccaaactcaaaaaatctgaaatctgaaacacttttggtcctaaacatttcagataaggaatacttaacctgtaattgtttccttccagagagttatactactgtctcccttccccaccctttataaaattagttcattggctgtaccttcagaacatcaagcaatagtagtaataggaaacttagtcttatatccaatttggtaccaagatatatgaatagatttattactattatatatctagagcggaccaggcttgcttgtaggttaattgcttagtacctgtgtagtgctggataatatttaatgctgatatgtaacttgcgtttcttatgagatccacagtaaatttcttattgtattgtttgtactattatgtttgtattatttgttatcgcaggattgttattaatgtgataaaatgaattgggatgctttctgtattttctattctgaaataagtgtgggatattgcattggaatggtctgttccttgaaagttgcagagtctgtgatgccagatggaccagaactcctgagttaattctccggcagctttttttttccttcttgattactcatgtatttcttccattttcttaatttcaatataggacagtgctaaaaacataaacattaataaatatctattgaataaatgaacgtatgggtgaacaaattttataactattaatttcctagaagaaactttaaggaattatatttttaaagcatattttacactactcttacgtatctgagatcctcttccttttctagatcctaattttatggatttccttttaaattagtaaaaagatgtttcccattgattccttcctcctcctttccttgaaagtttttattttcatatattaaataaaacatttctagaaagttatt

SEQ ID NO: 70126 - DNA, 357 bp, Homo sapiens
tgattaacccttgccactgaaatatgagtaaaagcatgtttgtcacctctaggccaaggcactgagatccagtcggccacctccatgctttctcttccattcaacagcaaacatggagaacccacattgaggtgtggagccacatgatggaaacaacctggttccctaggtcactgccaacccacttcaggttttatgtgcacgaaaaaagaaacatttatcatgttaacccattcatatttcaaggtttttgttgttgttgttgttggatcagttagcatttactttatttgagtaatatacacaactactatttctattgtctgtcaggcctattaaaaatattttaatcacaaa

SEQ ID NO: 70127 - DNA, 367 bp, Homo sapiens
tgaggtggagtttcgcttttattgcccaggctggagtgcagtggtacaatctcagctcactgcaacctccgcctcctgagttcaagtgattctcctgcccaagcttctcgagtagctgggattacaggcatccaccaccaggcccagcaatttttgtatttttagtagagacggggtttcaccatgttggccaggttggtctcaaactctggacctcaagtgatccgtctgccacggcctcccaaagtgctgggattacaggcatgagccaccaggcccggcccattttagtgctatttcttagtatttaatgtgctaaatatagtatttggtaaagaatgaaatcatcaaatttgtgtgtatactg

SEQ ID NO: 70128 - DNA, 617 bp, Homo sapiens
agaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcat

SEQ ID NO: 70129 - DNA, 2947 bp, Homo sapiens
ctcagttctcctcagggtcctggaggcttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacaggctcccacctccatgtccagagcagaggccaactccagccagacccttggaaatgccaccatggagaaatgcaaccacatctttgtggacactggcctaccggacctggctgtggggctcatcctgctggcaggatccctggtgctgctgtgcacctgcctcatcctcctagtcaagatgctcaactccctgctcaagggccaagtggccaaggtcatccagaaggtcatcaatacggacttccctgcccccttcacctgggtcacaggctactttgccatggtggtgggcgccagcatgaccttcgtggtccagagcagttctgtgttcacctcggccatcaccccactcatcggtcttggtgtgatcagcattgagagggcctacccgctcacactgggttccaacatcggcaccaccaccacggccatcctggctgccctggccagccccagggagaagctgtccagcgctttccagattgccctctgtcacttcttcttcaacatctcgggtatccttctgtggtacccggtgccctgcacacgcctgcccatccgcatggccaaggcgctggggaaacgcacggccaagtaccgctggtttgccgtcctctatctccttgtctgcttcctgctgctgccctcactggtgtttggcatctccatggcaggctggcaggtcatggtaggtgtgggcacgcccttcggggccctgctggccttcgtggtgctcatcaatgtcctgcagagtcggagtcccgggcacctgcccaagtggttacagacatgggacttcctgcctcgctggatgcactccctgaagcccctggaccacctcatcacccgcgccaccctatgctgtgccaggcctgagccccgctcacccccgctgccccccagggtcttcctggaggagctaccccctgccacaccctccccccgtcttgcactgcctgctcaccacaatgccacccgcctctaggctgtgggcccagactacagcctggaatggggaaggcctggtgtggaaaggcaggggagggagggtgtgtgtaggtatgtgcatgtgcctgtgccaccctgggtgccagtctctccttctgtagctccgcaaagctctgggcttgtgtgagagtgtcggtgtgtgtgcatgtgtgggggtgagtctgcatgtgcacctgtcatgtgtagaagcttgtatttgtgtacaggtgtgccagcccatgcaggtgtacacagacacacctgtgggaggctgtgtgcaggctgcaggatatctgggtatgatttcaggtcctctgcacgtgtacacatgactaggataggcaggagtaagggtgggtctgggtatatgactgtgcagctgtttgtgcatagatgttggtgcctgcgttactgaatttgcacacctccttgccaccttccttcctccaagataccatctcctcatcctaacccaggtcttcggccaccaccacaattaattcccttcccaacacttgcctgatgaaaaaaaaacaaaggaattaaaactctcctcaggcattcggaagtctttttgctctccatcaatggcaaagggaagaccaagccagggggttcagcagcaccatctcccctcaaagactggctgcaagagcagcctgccctgcccaggccaggtgcagttccagagaagccagccctgcaggctcaccccaaccatctgcctggccctaccttagtgagtccaaaccacaattcaaactccctggaagcccctcctaggcctggggccacccccaaggcaagtgtaaggaggattctgcacccccaccccctgacccccacctggctgaacttcctctggtctccctctgccctctaaattcacccacctcagccacacatca

SEQ ID NO: 70130 - DNA, 1780 bp, Homo sapiens
ctcagttctcctcagggtcctggaggcttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacaggctcccacctccatgtccagagcagaggccaactccagccagacccttggaaatgccaccatggagaaatgcaaccacatctttgtggacactggcctaccggacctggctgtggggctcatcctgctggcaggatccctggtgctgctgtgcacctgcctcatcctcctagtcaagatgctcaactccctgctcaagggccaagtggccaaggtcatccagaaggtcatcaatacggacttccctgcccccttcacctgggtcacaggctactttgccatggtggtgggcgccagcatgaccttcgtggtccagagcagttctgtgttcacctcggccatcaccccactcatcggtcttggtgtgatcagcattgagagggcctacccgctcacactgggttccaacatcggcaccaccaccacggccatcctggctgccctggccagccccagggagaagctgtccagcgctttccaggtgcgctgggagtgtagcctcgcctggggcaggatggagctgcctctggggtgtggggcctcacaaaggtgtgacaacatggaacaaatattttgactgcctactaagggccacctaatatgctcaatgaaaccattatgggcaaagtagacccaataccaccctcgagaccttagcatctaatagggagacactgctcataattacaccaataaatagcagtgagtcggatttgcaccataaggaa

SEQ ID NO: 70131 - DNA, 2078 bp, Homo sapiens
gccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaacaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaatt

SEQ ID NO: 70132 - DNA, 5769 bp, Homo sapiens
  misc_feature (2426)..(2426): n is a, c, g, or t
gccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaacaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacacnttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatgttttgtaaaattcgtaaaatcttaacttgaactaactctgggttcagctttacgtaagtcacgtcggacctgatgttagctgtaatcagttttgagctttaaggatagttgctgttgcttgggttctgaatgtatgagaaaactccctgtttatatgtagttctaatttaggttattttaaatccatgattaacttacattcccttttaaaattatggttttattgctgcaagagatttatttttgttatactaaactatggaaaagtttttcatagcatttttttcaagtttatttttgtgtgcttcatttggagtttttgtttatatacattgcgctcaaaaaagtagttttttgaaaaattcagtaagatttgaatctatacagtttaactgttatgacctttatgcgtgttgttttcactttatatctcaaatgccagagttcacaaaaatagctgatcttcattaattacatcttaattagaaccatttgttctcttccgtgtctttgaccttctaagttttgattttaaagaaattccttgcactacagccttttcttaaaatgcaagattctcactttgaaggttttgtgttggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggcatactttgtctatagaaaaatattttgacctttaggtacattttgggccagtagtcaaataatcctagggccgatataaaaatcttagaataatttaaggtttgccttttatacctgttttgaaagcctttacatttttgtcaggtaatttttcccaagccgtggatataatctattcaaacatgtttatgctatccattctgtttttaaattgaaaaaaatgttaaaagtgtttatgaagaaaagtttaaataaaatatttttaatctttaaaa

SEQ ID NO: 70133 - DNA, 6551 bp, Homo sapiens
  misc_feature (2426)..(2426): n is a, c, g, or t
gccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaacaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacacnttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatgttttgtaaaattcgtaaaatcttaacttgaactaactctgggttcagctttacgtaagtcacgtcggacctgatgttagctgtaatcagttttgagctttaaggatagttgctgttgcttgggttctgaatgtatgagaaaactccctgtttatatgtagttctaatttaggttattttaaatccatgattaacttacattcccttttaaaattatggttttattgctgcaagagatttatttttgttatactaaactatggaaaagtttttcatagcatttttttcaagtttatttttgtgtgcttcatttggagtttttgtttatatacattgcgctcaaaaaagtagttttttgaaaaattcagtaagatttgaatctatacagtttaactgttatgacctttatgcgtgttgttttcactttatatctcaaatgccagagttcacaaaaatagctgatcttcattaattacatcttaattagaaccatttgttctcttccgtgtctttgaccttctaagttttgattttaaagaaattccttgcactacagccttttcttaaaatgcaagattctcactttgaaggttttgtgttggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggcatactttgtctatagaaaaatattttgacctttaggtacattttgggccagtagtcaaataatcctagggccgatataaaaatcttagaataatttaaggtttgccttttatacctgttttgaaagcctttacatttttgtcaggtaatttttcccaagccgtggatataatctattcaaacatgtttatgctatccattctgtttttaaattgaaaaaaatgttaaaagtgtttatgaagaaaagtttaaataaaatatttttaatctttaaaaaaaaaaaaaaaaaaaaaaaaaaaaaaaaaaaaaaaaaaaaaaaaaaaaaaaagaaaagaaaagaaacaaagagagagaaaaaaaaaaaataaagataagaacaagaaagaagaaagaacaaacaaaagagaaacaaagaaaaaagagagagagcagcgagacagcaaacaaaagaagagagagagagaggcggggcgacgcgcgcgcaacaacaagcacctgcggcgacgcagcaccaacacaaccgagaaaacgaacgaagagcaaaatcctggacagaaagggagagacagcagcgactccatgcgaacgaagccaaaacaaagataaagacaacacaagacgacacacggatagagcgaaaaagaaaacaaaaacaacacaaagaaagggacaaactagagagggcgaaaaagacggagaacgcgtcgcacaatcacgcgtcggcaaaaacagagaagaaatagaaaataacaaaacccccaaccaacgcgaccgagacacgacagagaggacagagaaaccaaaacacaagaagtatagctgaaatatagaacagtagtagattttgaggtaaacacatataaaaaaaaataaaaataaaaaacaaaagatagtgacaacagacagaggaagaacaaacggcgacacagaggaggacagaagtgatcggcagaataaaagggaaaagagaagggccctaacggcgaaaaaaaaagaagaaaaagagagaaagacaacgggcacgcaggggagaacagaagggaagggacacgggggga

SEQ ID NO: 70134 - DNA, 4167 bp, Homo sapiens
  misc_feature (2426)..(2426): n is a, c, g, or t
gccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaacaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacacnttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatggcatatgtatgtgagcatggatatgatcgggggatgacttcagacccctaataaactcaagaaaatgccttaagaaggttgcttgtcttcccttttgtacttttctgtgggatatcttctgccatagtaaaagaaaatatggctcttgtgagcacatgaactagcgtattattacctgacgtttctcttggaccacgcttcttatttcaggttaatagcttgttctgtaagtatcacaactgcaggctctctggctcaacactggtattgatgtactggcaaagatagtgcc

SEQ ID NO: 70135 - DNA, 209 bp, Homo sapiens
caaacattgatggtaaatgtcttattcttaaagagatcttattctgaaacaacttgaatctttgtttttatgctgtgatattagtggctgtggcagtgcctagaattgtttaattgcctaatgcacaaaggtgagcactttgattgatgtgtattcagagaagtactttaataattttataaataaagaactctccagatgactgaatg

SEQ ID NO: 70136 - DNA, 472 bp, Homo sapiens
gtgttcaaataccacctccgctcacaggtgctgcctgtctgaatttaggctccaggcttctcatcttttcaacggaagggataataacgttcacctgcacagtgctcttttgaacaagaaacaagattacgtatgcaaatatcttaagtgccattacttttaaacaaatggagtttgttaattttattatttctacttttattattccccaagtcattatttgaacacctagaatggtgcttggcaaatagtagtcacacaatacatatttgtagaacagatctttgaacaaatacatagtaaaatgaatgaattaatgaataccaaattactgtgaaaaacgttcagaccgaagaaaaatttgctgaaaaggaaccagcttccctttcgtgtctctcccagctcaggcaagcagcccacaagggggcgctccctgagccttctagaggcagagcggcctgttgggaaaggt

SEQ ID NO: 70137 - DNA, 274 bp, Homo sapiens
aggacggccagacacctggaagccggaaaatggactcagtggcctttgaggatgtggcagtgaacttcacccaggaggagtgggctttgctggatccttggcagaaaaaactctacagagatgtgatgctggaaacctataggaacctggcttcagtaggtgatgacgacaacattccttcacttagagaacaagttgcccatcaacgatatttcaagacctggcatgtggaaagggaatacttcagtaaataaaccaagcatggtgacagcta

SEQ ID NO: 70138 - DNA, 320 bp, Homo sapiens
cctacttatagcggagactacagtcaaaacaaaataaaacaaatcctctaatgctatcagagccaagaaatctatcaatcatatatacattttttaaatccaggagtgtttacatttcagcatataaatcttatcaagctaaaatagagtatatattctgatgttgtaactgatagatcataccctcactggctttgagagtccccaaacatttattgtaaaggtttccaactacactagcaatcttttgtaattgaataaaatgccaatttatatttgttgaataaaagattatctggggtactgctccttccgaaatg

SEQ ID NO: 70139 - DNA, 406 bp, Homo sapiens
taatgtattagtcatactgctcacaacagtagtccagataactctgttgacaatgatttttacctatataaaacagattgagatgataaaggtcctaggttcttaaattaagataatattgatgtgatctctttggaccctccctaacgggaaatgtgtacccttcccctataattgttgctttggtagacaaatttgtcttaaataataaagaaattaaaacaatgaatattatttataacctcagagaagtgagcaatgactatcttgaatttgatctgaaatcttttttttaaatgtcctgggtcttttagcctgtgtacactcattagaaggcatgctctttttttttttctttaataaacactgaaccctttccaagagtttgacaattatgcagagtttc

SEQ ID NO: 70140 - DNA, 342 bp, Homo sapiens
gaattcccccccccccccccccccccaaaacaagtgtgtgctgcaggcagagttagaacctggggtggctgatactcagaccccatctctatacataccattatactgtggtggatctggtgtgctatttttcagactgtggggtatagccactagtgggatatgaagtccaattattgatctttttcttttgcattggaaaaccaaggaaatggaagaggagagaaaaagcagaatgcattttaaatgtggcttctggaaacttttgtttgggagaaatgcaaagaagcagatgtgggtcagtgtcaaaaagtgtgaaagccgttgcatccaggctagggg

SEQ ID NO: 70141 - DNA, 184 bp, Homo sapiens
ctttcttcattaatgggagaaatgtaactaagcttcattcatccaggtagaattggaatgttgtccagtctttttattctctgcttccttttctctgctagaaatgtcttgtctcttaggaagttacactataatcatgttatgtgttgtcattttatcttatagttctcttaagactttattg

SEQ ID NO: 70142 - DNA, 500 bp, Homo sapiens
cgacagattgctgggagctgctatgcacaggcatggatgaggttgtttttcccctgctaaatgtaattacagaggaattcagaagtctcagatattactgagaaaaaaaaaacatgtttatttatttatatgtacttgtacctttcagaatacagtgtcctttttttacagtgtcagattttttagtcaggaaagccttgaaaagtcatcagcatttccctttcccacacatttgtagccatagtcaaaaactctctagtagattttccatgtgtgcaaagaaagatatttcttggatgttaggagagaatgcccccagttttttccaaactgattattcctgggtatttaaatatgtttcttatcagtgtttcgtaacgtataatgattgtgaaagcaaagagcatgatgatatttgggggaaagaatcgcctacaaatatctgaagtgtttatttaaccacagactgatactctaataaaataaagaagtaatgctat

SEQ ID NO: 70143 - DNA, 497 bp, Homo sapiens
atggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaatctcaaatcaatcaatcaatctaatgattagtattataattcaggtatgctctagatctccaagaatttagaaaatacaaggcagatgtcaactgtgtgcctatatatttagatatcacttttaataata

SEQ ID NO: 70144 - DNA, 330 bp, Homo sapiens
cctgaattcagatggaatagaattgtttcctttgattttttcactttgagcactccctggcctactttcttcccttaacttttaatagtgctatgactttactcaagggaggatgtgttctttagaccaaccctatcatagctggaataaatctgtataactctcttcccctggatttaggtagctggatcaggtttcctagctgtagccagttccttgttcactaacttgcttgagctgatgagctgtgggtctttctagagagaagtaacccttgatatttatatctgtgaaaaaaatatcaataaatttgaaatgttaaatgatcta

SEQ ID NO: 70145 - DNA, 1032 bp, Homo sapiens
  misc_feature (1032)..(1032): n is a, c, g, or t
ggggtgggggtggggagggggcggtcaggcggcggggtgggctggtggagaggcaggagagctctgcccgggctgctcccacagcccaggcggctgcccgcaaacccgcgcgtgcgcagtaggcggcccacctgctggtacctgggccggctctgggatccccgggatgcccaggaaagaatggcagttctccgctgtgtggagtctctcaccgggcctaggcctagaaggcaggaatcccaggccggtcagcccggtggagggggcggggcggagacacgcccctccgtagccagccaggcgttccccgcgaaagagaggccaccgccctgccccgaaccacccgaccccgtcccaaccccgcgtcctaaagctcctccagcagagcccggtattcttcctcgctgaggggtgcttccagcgaggcggcctcttccgaggcctccagctcccccggggcctccgtttctaggagagggttagacacagataaactgtttcacgttagacctgtaagccaaggagatgtgtatagagctgaaactgaagaaatgcctaaaaatattccagatactatatgcaaaatgacggtgaatgtagaaaagattgtacgagaatggaaccagtacaagaaggtgaaaaaaataatttccaaaaatcaccaaaggcgcatgaaagttatcctacagtctaacacgttactgccagttgttgatgccgtgccagacctctcgggatgtataagacaacctggcctagaatgtgaagaaggcagtaagtgccacaaggccctagaaaaaaacgagcgagagcacggacgcacgcagtggggaatacaaagaaaaagctgcggcagatgcccaggaggaacacaagagggcacaagagaaccggagaaccaaggtagggagagaccagaagagggcagcaaggaagcatcggaggggaaatggcagaaccgtaagacaaggcgagaacaaaaaaacgaggaagaaaaagaggcgacaagaggctgcgcattgtgtgtcgggn

SEQ ID NO: 70146 - DNA, 3723 bp, Homo sapiens
cgatcactcttcagcatccgcagagtgattttcaaaacatttactaacgctttcaattatttaccccattaatggaatttgtcaacagactggagtccttgacaggattgtgaatgcatagaggatgcaaagaaatggacacactgaggtagctatgccagtggtctgcatgcgcaggcagtaaactgaagacatttgagcggtgaattacttggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcataatcatcatgtgtatgcattcagctttgattgggggagagactcagatgcatctcttggaatgtgctcatgatctgaaaatgactgatggaacctacgtctttgttccttatgatgccctgctctacagtttaccttataagcacaccccctaccaggtcctaaggaacaacccaaagctccgggaagcctatgatgcagtgttgaccattacagtggagtcccaagaaaagaccttctatcaagccttcacagaggcagcagcaagaggtgaaattcctgagaagctggagttcgatcaagtttcaccgttgtttggaaccatctacaattcaatttactttatcgcacaagccatgaataatgctatgaaagaaaatggacaggctggtgctgccagcctggttcagcattccagaaacatgcagttccatggattcaaccagttgatgaggacagattcaaatggaaatggaatttcagaatatgtaatcctggacaccaacttgaaagaatgggaactccatagcacctacactgtggacatggaaatggagctgctacgtttcggagggacccctattcacttccctggtggcaggccccctagagcagatgcaaaatgctggtttgcagaagggaagatctgccatggaggcatcgaccctgcctttgccatgatggtctgccttactttgcttatagccctgctgtctattaatggatttgcttactttataaggcgtcgtataaataaaatccagttgatcaaaggacccaatagaattctactgactttggaggatgtaacgtttatcaatccccactttggcagtaagagaggaagtcgtgccagtgtaagcttccagattacctcagaggtccaaagtgggaggtccccaagactctccttttcttcagggagtctaactccagctacctatgaaaactccaacatagcgatttatgagggtgattgggtgtggctgaaaaagttctcccttggagattttggagaccttaagtccatcaaatcaagagcaagtgatgtgttcgaaatgatgaaggacttgcgtcatgagaatattaaccctttattgggtttcttctatgattcggggatgtttgccattgtgacagaattctgttcccgagggagcctagaagacatactgacaaatcaagatgtgaaacttgactggatgtttaaatcatcactcttgctggatctcataaagggcatgaagtacttacaccacagagagtttgttcatgggaggctaaagtctcgaaactgtgtggtagatgggcgttttgtactaaaagtgacagattatggctttaacgacatcttagaaatgctgagactctctgaagaggaatcttctatggaagagctgctgtggacggcccctgaactgttgagagctccaagaggcagcaggttaggttcttttgcaggagatgtctatagctttgccatcatcatgcaagaagtgatggtccggggtaccccattctgcatgatggatctgccagctcaagaaatcataaacagacttaagaagcctcctcctgtgtacagaccagtagttcctcctgagcatgcccctccagaatgtctccagctgatgaagcagtgctgggctgaggctgcagaacaacgaccaacttttgatgaaatatttaaccagtttaaaacttttaataaagggaagaagaccaatattattgattctatgcttcggatgttggagcaatattctagcaacttggaagatttgattcgggagcggactgaagagctggaaattgaaaaacagaaaacggaaaagcttctaacacagatgctaccaccatcagttgctgaatctctcaaaaagggctgcacagttgaacctgagggctttgacttggtcaccttgtacttcagcgacattgtgggcttcacaaccatttcagccatgagtgagcccattgaggtcgtggatcttctgaatgacctgtacacactctttgatgcaataattggcagtcatgatgtctacaaggtagagaccattggagatgcctacatggtggcttcaggcctcccaaagaggaatggcagtaggcatgcagctgagattgcaaacatgtccttagatatcctgagctctgtgggcactttcaagatgcggcacatgccagaagtgccggtccgaattcgaattggccttcactcagggccggttgttgctggagtggtgggcctcaccatgcccagatactgcttgtttggagacactgtgaacacagcttctcggatggaatctacaggcttaccttatcgcattcatgtcagtctcagcactgttacaattcttcaaaatctgagtgagggctatgaagtggagcttcgaggaagaacagagctcaagggcaaaggcacagaggaaaccttctggctgattgggaaaaaaggcttcatgaagccccttcctgtgcccccaccagtggacaaagatgggcaagtgggccatggcctgcaaccagtggagattgcagccttccaaagaagaaaagcagaaaggcagttggtgagaaacaagccataaggggcaaagggctccaggatttgaatcttctcttggtgaggcaatgggaaagctcacttcagttcaagaaattgttctgcctgggcaagaaattacg

SEQ ID NO: 70147 - DNA, 1521 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70148 - DNA, 2022 bp, Homo sapiens
  misc_feature (598)..(598): n is a, c, g, or t
  misc_feature (899)..(899): n is a, c, g, or t
  misc_feature (920)..(920): n is a, c, g, or t
  misc_feature (968)..(968): n is a, c, g, or t
  misc_feature (1001)..(1001): n is a, c, g, or t
  misc_feature (1168)..(1168): n is a, c, g, or t
  misc_feature (1225)..(1225): n is a, c, g, or t
  misc_feature (1524)..(1524): n is a, c, g, or t
  misc_feature (1682)..(1682): n is a, c, g, or t
  misc_feature (1922)..(1922): n is a, c, g, or t
  misc_feature (1996)..(1996): n is a, c, g, or t
gagaatacttatactacttttcaacgtttttaaaaaggatgtaaatttaaacttatttttttgttaacttctaatgtagatttctaagtatgagaaaataatgaagttaagtatgtttctcagtataagaaaatacttttgaatgaattgtgattattagtagtatataaattaatatattatgattgtaactttgcaattattggtcatgaaaaaagtagtgcactgcatgtgggtgcaattaaattgcgtgaaaacctaattgtgaccctccctagccttgggctgtagggcagagatacccagttacatgaaggagtgtgagccccattccaaaaagctcccatcctctgagtggtgctcaaaagtcgcctcctaaccagtagcacagcctgtgtttctgctgctgtctagaatgcctcattccaacctctgacgcccatctgaccgtgctggcggttgccacactgtcctgtcttgtggttttctgtccatccccatttcacagtgggcatttctcttggtttctgtcccatccagagcacaccatggccacgcccctggaggatgttggcaagcaggtgggtaggtcttgtcngcttcctgtggccctgatgggtccctgcagagcctcacgctgcttgtcgctccttgtcctcttccctccaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacaggtaatgaggtgacatctcaggctgcagggaagtagtcaccttcacaaagcatgcactgactgtataaaaaaagaggcagaggcantggaaattggatgttagctgntgttgattttgccatcctggtcccctggccctctccactctccatttnttctcagtgacatcaaaatgacccagcaatacncactcagcagcagcagcgtcacccagtggctataaggccattgagcttcaggaggtgcctagcgcccctgctggtacctctctccccactcctgagaaagagcaaatatctccaaaaacaggaggaatatacccttttagaagcctttgaaagcaagtttattattnttttcctgggtatagaagccttgcccattctttgtaggaggtttttaaaacagtacntaaaaattactcataattttacaatccctagattgaatcaacaatatgcaacttatgggtcacctcccgtgtgccactcatttctagatgtaggaggccctgcggtgaatggagctgactaggcactgccctcagggcgcttacgttgtaagaatctcctccaaatgatagctgaaatcaagctgcagcagcactgtattctgctgaaaatgttgaaaaacatttttaagagcattttcttttttaaatatgtatatatttagggggtacaagtgcgggtttctgatgtgcagctatantgcagtgatgacatccgtctgggcttttagtggaccttccactcaaatagtgaacattgtacccaatagggaagctttaatcccccacccctcccaccgtgtcaccttctggaatccccagtgtctgtgtttccactcagtatgtccatgtttacccnttgtttagctcccactcataagtgagaacattttaagagcattttctcatgccattaaaaaattattatataggccaggtgcggtggctgacatctgtaatcccagccctttgggaggctgaggcaggcagatcacctgaggtcaggagtttgagaacagccaggccaacatggtgaaaccctgtctgtactaaaaatacaagaattaaccagatgtggtagcggcgggcacctgtaatnccagctacttgggaggcttgaacctgggaggcagaggttgcagtgagctgagattgcaccactgcactccagtntgggccacagagtgagactctgtctc

SEQ ID NO: 70149 - DNA, 695 bp, Homo sapiens
ctgtctcttacttttccacagggatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggtgagctttgcgccacgggaaccgtgctgacgtcccgagtgtcagcggaactctcacctcctaattgtgtccttgttagtgtcattatgattgttactcagtgccacttattgagcacctactatgtgccaggtctgtgctcatcctttgtgtacgttactgcactgaatctgcatcctagccctgtgtgcaggcgctgctgtcccacttgactgatgaagagaggaaggctggaaagcatcaggggccttggccagggcacggctagttagtgatagacaaggacttgaatgcagactgtactggaacctcaactcttggccagcacacactgtcgagagcttctcttcctgaatgttctc

SEQ ID NO: 70150 - DNA, 1382 bp, Homo sapiens
gacaggcgctcagtaaaagcccgtccaggggatatgagatcagtgagggataggaaagcaaggtgggtagaaacagcaaaacccttcccattgatgatggcagtttgtgcgtccggctggctggtttgcaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggtaggtccaggccccgaagcagggccgttggttgctttactgtgaagcgggtgactccagggcaaagaggtgatgaagcaagccctccaagcacaggctccaccctagtcctgcagggggtgaagcctgcgtgcctggcaccatctgtagtggaacctgttgggggagctacatcctgttcttagcagccaccatgtctggagacgggcctacaggcgaaccttgtcttttactttatagcacatattccccccgttggacagttcagactccagaggaggcaagaccgaggcagaggttgtttggggaacaggaagtcagtggagggaagtttgtgggttgcagatcttggtgcaggcgccccgctgtggtggccgctgctcacatcttcactgtggaaggataccagcccctctcggactgaactggcttttctattaactggagtccaaagattgagaattaacttcttttgttctgtttgccttttggctgtggcctccctttctctatgtctgtggagacccgggcctagttctaaggaaaaagggaggaagagggagtcacgaggagctgccgcccttgcactctgtctcgcgtcctgagggagggcagcatggaattcgtgtggttttgtgtgcgaggaggatcttgtatttattgctctgccacttctgggcagcattaagaatagcgtcacatgaccaagaacacacatttcttacaagtcagcagccccaatacatgatgcctaagacgtcccaaaaaggccaggtacggtggctcccacctgtaatcccagcactctgggaggccatggtcggagggttgcttgaagctaggagttcgagaccagcctgggcatcacagaccctatctcgacaaaaatcaagaaaaaaaattagccatgcatggtggtgcacacctgtggtcccagctactctggaagctgaggtgggaggattgcttgagcccagaagttcaaggctgcagcaagctgtgatggtgccactgcactccagactgggcaacagaatgagatcctgtctctaaaataaaattgtttataaagatctccccca

SEQ ID NO: 70151 - DNA, 982 bp, Homo sapiens
ggcggggccggcgcctgcgcagaccgcctgttatggcggccgcctaagtcccacagagacgggagtcgggtgggatcccaggctgggccccgcggcgggtaagtgcctgggagaggcggcgggatagggtagggtgcagggaacctcctggcgccgagcctgactttgaaatccgagctcccacagatcggaggcccagatccctaaggcccgaccccactcttagcgtcagtttccccttctcaacacgggtgttggggaaagaagtccacgtcctcacctgggtttccatcctgggtccaggcacctctccttcggttctagattaggaagggagggcagtgcccgacctgtgactgttttttgagagggcaatagttaacccacaagggtggcgtcaggaaggcgacaagacaaagagaacgagtagccccacgggggacgtccccggagcccctcactaccactctacgcaccgtggccaggccacgtctttcctgctcccatcctgggccttcacaccctgccctccccagctcctggcctaaatcgtcatgggatcgcgccaaattcttgattgttgagtgagttgcagttatcagaaagaaagatgaggagggaagttatttcaacaccgtgatcccagcacactgcttatttgggacaactgactggggacctataggagaagaaagctggtagcgtctcagtctagcccccacagccttagaagagccaagaacacgttagctcctgctgcagggatgagcctgcagccctatggagaggtggtggggcaggtccccatctgcaacctgggtctcctttctcagctctgcccagtaaagagaggagcccgaagcccatacagaccctgcatttccggaaagagacttttcctgactagagaaactgttaccttttttctttcttcccagcattcactttaatcattattatattgctataatgatagtattta

SEQ ID NO: 70152 - DNA, 139 bp, Homo sapiens
gcggccgcctactactactactgctcgaattcaagcttctaacgatgtacggggacatgacccatcgcctccaccaggcgcggcgtctcgactgttcttagagtgtatttctagtaaaatcagaagctcaccaaagcaa

SEQ ID NO: 70153 - DNA, 1777 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaaaaaaaaaaaaaaaaaaaaaaaaaaattgtggcgggcgcgccgggacccgggaaaaagtttctcaacaccttctcgttggggggcgggggcgcccaagagggttagtgaacacggccaagaggtctcccaaggagaaccccggcccggaccacgtggtggcttccccaccaataaaaaacgcggggacacgggggttctgacaatccggagggtcggaggcatcggactcacacggggccagaacggaaaaaagcga

SEQ ID NO: 70154 - DNA, 1394 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatgcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70155 - DNA, 1599 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggtgagctttgcgccacgggaaccgtgctgacgtcccgagtgtcagcggaactctcacctcctaattgtgtccttgttagtgtcattatgattgttactcagtgccacttattgagcacctactatgtgccaggtctgtgctcatcctttgtgtacgttactgcactgaatctgcatcctagccctgtgtgcaggcgctgctgtcccacttgactgatgaagagaggaaggctggaaagcatcaggggccttggccagggcacggctagttagtgatagacaaggacttgaatgcagactgtactggaacctcaactcttggccagcacacactgtcgagagcttctcttcctgaatgttctc

SEQ ID NO: 70156 - DNA, 1761 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctgcctctctgccacagtaaaacagaacagcccagagcaacaaagaaaggaggaagccgctcgtccgctcctgccccagctcgcctgctccgtggctgacgtgttgtctaactactctccttgcctgctccgtggctgacgtgttgtctaactactctccttggtgaatcactttccttaatgaaattgtgatgctcttgtatgtgcacttcagaaacctgttcttttctctatttgctgcaggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70157 - DNA, 1721 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctgcctctctgccacagtaaaacagaacagcccagagcaacaaagaaaggaggaagccgctcgtccgctcctgccccagctcgcctgctccgtggctgacgtgttgtctaactactctccttgcctgctccgtggctgacgtgttgtctaactactctccttgcctgctccgtggctgacgtgttgtctaactactctccttggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70158 - DNA, 1408 bp, Homo sapiens
  misc_feature (598)..(598): n is a, c, g, or t
gagaatacttatactacttttcaacgtttttaaaaaggatgtaaatttaaacttatttttttgttaacttctaatgtagatttctaagtatgagaaaataatgaagttaagtatgtttctcagtataagaaaatacttttgaatgaattgtgattattagtagtatataaattaatatattatgattgtaactttgcaattattggtcatgaaaaaagtagtgcactgcatgtgggtgcaattaaattgcgtgaaaacctaattgtgaccctccctagccttgggctgtagggcagagatacccagttacatgaaggagtgtgagccccattccaaaaagctcccatcctctgagtggtgctcaaaagtcgcctcctaaccagtagcacagcctgtgtttctgctgctgtctagaatgcctcattccaacctctgacgcccatctgaccgtgctggcggttgccacactgtcctgtcttgtggttttctgtccatccccatttcacagtgggcatttctcttggtttctgtcccatccagagcacaccatggccacgcccctggaggatgttggcaagcaggtgggtaggtcttgtcngcttcctgtggccctgatgggtccctgcagagcctcacgctgcttgtcgctccttgtcctcttccctccaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70159 - DNA, 1135 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70160 - DNA, 937 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtaaatagaggtgtgatgtggcccacctgtcaccaaggcaactccgcagtgtcactgctcagggctcagtatgatctgagcgtggactctgcaggcccaggcagcacaggttatgagaaccagctcgggtgagactggggaagctctccacaacc

SEQ ID NO: 70161 - DNA, 717 bp, Homo sapiens
ctgaaatccgcccgctgctcactggctagagcagacactcagcagaaaaggcacctcttccaccatgactctgcacccgggcagcagtgggcctgaagcagggagtctggtctgcctggtggtgcccactgcaccgagctacccccagccctgtttcttctcttgaagtgccttttggtcagtcccagtgagagttggtggccaggagagaaggcaatgggcacaaagtgtgcttttgttctttcttagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70162 - DNA, 878 bp, Homo sapiens
ctgggtgcttgctctttctttgtataaagatgtctttttttttttccctgtcagatggcagatgggaaaagtcgttccttgagtactggtcacctgcctagcactttgcgcaccataggcccttcggccctcccaatagtcctgtgaggaagtagtactgtgccctttctatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctgcctctctgccacagtaaaacagaacagcccagagcaacaaagaaaggaggaagccgctcgtccgctcctgccccagctcgcctgctccgtggctgacgtgttgtctaactactctccttgcctgctccgtggctgacgtgttgtctaactactctccttggtgaatcactttccttaatgaaattgtgatgctcttgtatgtgcacttcagaaacctgttcttttctctatttgctgcaggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70163 - DNA, 1062 bp, Homo sapiens
  misc_feature (1062)..(1062): n is a, c, g, or t
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccccgccctggaggatgttggcagcaggtgtggcgggcgcctgtcctgggactactcctgtccgacagactctcgaggtgtcagcgctggactcggggccgcggtcgtgctatcgcgcccagggcggccgttgtccagtcgggcgttctggccgtgccggaattgcccacccggtgcgggggtttgcgccccgggggggccgcccccccgggggtgcccgggcggcgtggccccccaggggggaccgcttctgttgtgacgtcctggn

SEQ ID NO: 70164 - DNA, 415 bp, Homo sapiens
gacaggcgctcagtaaaagcccgtccaggggatatgagatcagtgagggataggaaagcaaggtgggtagaaacagcaaaacccttcccattgatgatggcagtttgtgcgtccggctggctggtttgcaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70165 - DNA, 1650 bp, Homo sapiens
  misc_feature (840)..(840): n is a, c, g, or t
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgggtaggtcttgtcngcttcctgtggccctgatgggtccctgcagagcctcacgctgcttgtcgctccttgtcctcttccctccaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70166 - DNA, 1660 bp, Homo sapiens
ggcggggccggcgcctgcgcagaccgcctgttatggcggccgcctaagtcccacagagacgggagtcgggtgggatcccaggctgggccccgcggcggcttttgctgccccacagcaaccacttaaatgtaggaactccagcagtgtactgggatcattaggacagcctgagtcatgatgacctcattttgcagttgaagaagtgggggccctgaagatttcatgacatctacccagctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70167 - DNA, 2488 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggtaggtccaggccccgaagcagggccgttggttgctttactgtgaagcgggtgactccagggcaaagaggtgatgaagcaagccctccaagcacaggctccaccctagtcctgcagggggtgaagcctgcgtgcctggcaccatctgtagtggaacctgttgggggagctacatcctgttcttagcagccaccatgtctggagacgggcctacaggcgaaccttgtcttttactttatagcacatattccccccgttggacagttcagactccagaggaggcaagaccgaggcagaggttgtttggggaacaggaagtcagtggagggaagtttgtgggttgcagatcttggtgcaggcgccccgctgtggtggccgctgctcacatcttcactgtggaaggataccagcccctctcggactgaactggcttttctattaactggagtccaaagattgagaattaacttcttttgttctgtttgccttttggctgtggcctccctttctctatgtctgtggagacccgggcctagttctaaggaaaaagggaggaagagggagtcacgaggagctgccgcccttgcactctgtctcgcgtcctgagggagggcagcatggaattcgtgtggttttgtgtgcgaggaggatcttgtatttattgctctgccacttctgggcagcattaagaatagcgtcacatgaccaagaacacacatttcttacaagtcagcagccccaatacatgatgcctaagacgtcccaaaaaggccaggtacggtggctcccacctgtaatcccagcactctgggaggccatggtcggagggttgcttgaagctaggagttcgagaccagcctgggcatcacagaccctatctcgacaaaaatcaagaaaaaaaattagccatgcatggtggtgcacacctgtggtcccagctactctggaagctgaggtgggaggattgcttgagcccagaagttcaaggctgcagcaagctgtgatggtgccactgcactccagactgggcaacagaatgagatcctgtctctaaaataaaattgtttataaagatctccccca

SEQ ID NO: 70168 - DNA, 1801 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctgcctctctgccacagtaaaacagaacagcccagagcaacaaagaaaggaggaagccgctcgtccgctcctgccccagctcgcctgctccgtggctgacgtgttgtctaactactctccttgcctgctccgtggctgacgtgttgtctaactactctccttgcctgctccgtggctgacgtgttgtctaactactctccttggtgaatcactttccttaatgaaattgtgatgctcttgtatgtgcacttcagaaacctgttcttttctctatttgctgcaggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70169 - DNA, 1140 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70170 - DNA, 1042 bp, Homo sapiens
ggcggggccggcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtgaggcccagggggtcttctgccagggagggaggtttctctg

SEQ ID NO: 70171 - DNA, 638 bp, Homo sapiens
ctgggtgcttgctctttctttgtataaagatgtctttttttttttccctgtcagatggcagatgggaaaagtcgttccttgagtactggtcacctgcctagcactttgcgcaccataggcccttcggccctcccaatagtcctgtgaggaagtagtactgtgccctttctatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtgtatttctagtaaaatcagaagctcaccaaagcaa

SEQ ID NO: 70172 - DNA, 330 bp, Homo sapiens
  misc_feature (27)..(27): n is a, c, g, or t
aattcgcggccgcgtcgaccgggcganaagacgacagaagggattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaa

SEQ ID NO: 70173 - DNA, 6135 bp, Homo sapiens
atagtgagggtaataatgacttgttggttgattgtagatattgggctgtttggacctgcattattaaaagatctcagtttatttaaagactgtgaacctgaaagcatttctgattggacttttgatgaaaactgtttattctgttgcttgagaagagataaagtaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacggtgagaactcaacagaggcaaaagcagtagattctaacaatcagtcgaagtccccactggagaaatttatggtcaaactgtgtactcatcatcaaaagcaattcattcgtgttctgaacgacctgtacactgaatctcaaccaggcactgaggacctgcagccttctgattcgggagcaatggatgtatccacttgcaatgctggctgtgcccagctcagcaccaaacataaggaaaaagatgctctgtgtctcgatatgaagtcttctgcttctgtagatttgttcgtagactcgtcagactctcacagccctctacacttgacggaacagaccccgaagaagcctcctcctgagataaaccctgtagatggaagagagaatgccttgactgttgtccagaaagattcctctgaacttccaaccactaaatcgaattctattaatagcagttcagtggatagtttcactccgggatacctcactgcatctaattgttcctcagtgaacttccaccacatccctaaaatcttggaggggcagaccactggacaagagcaagacacaaatgtgaacatatgtgaggatggtaaagaccatatgcagagttcagctttagtagaaagtctaattacagtaaaaatggcagctgagaatagtgaggaaggcaatacctgtattattcctcaaagaaatttgttcaaagctttatcagaagaggcttggaactcagggtttatggggaactcatctagaactgctgacaaagagaatactttacagtgtccaaaaacacctttgcgccaggatttagaggcaaatgaacaagatgcaaggccaaagcaagagaaccatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaagcctttcaaatttacagttaatggagaacaccgtaatttgagatgtcagaaaatgcatctcagatggagaagggaacttgcagagtccttctctgaggctaagggaagttatatattatattctggttgttccttgggttttaaacttggaaccaagcagttttcgtttttaaaagtacagtgccttatttatcctttttgtttttaaatttacaaaagctaaaaagctgatctatgtgattaaaggcttgtattttatacttgatgcacaagcacttgtactgtagccgagaagaccaccatcatgcacataaaaggagcttttcagcagccaccctgcagcatctgcccacgaacagatgcccttctttgcaaaccccagcagtgaacttccctctctgtcttgtttgtttgtttagatgatgtttgaaagctaaaccaaatcattttatggtatgcagaggatttataattataaaagattactatttctgttacccccttttaaaaaagatcatgttcattgttggtccctcctctcacctttgatgttttgtcatttgagagcatgtattctaaattatgtgcccatgggacaagagatatgtcacaagtgttaatttttgtttacaaactctaaaaaatcatttgcatccccaaactgtattactaattctcaccatcttcttcatttctggtcttgctagcactcctgcaaggcttccatcctacttcgggaggaaaaagcctaggattttttttttccatcttgtagctgtaatttgatgattaggatgaaaatgactcttattttctttcttacccagagtacttccatattcaaagaaagccgaactattatttccagtaatagaaaggtttaagaatatgtatgtccatgtgtgtttgggtgcatttgcatgtggttatcagccacaaatgtctcccaatcccaattttacagtaaaattttttccctatgcagtgtgcttgggtgtccctgagttgagtaattagcaaaggacagatggtttaaaagtagcccagtgtctctgtgagcatccccaataccactttggtaccagactcagaaagatctaaaacagcatggagttatgtaaaggttagagcagccttgcagttggaggaagcag

SEQ ID NO: 70174 - DNA, 5487 bp, Homo sapiens
atagtgagggtaataatgacttgttggttgattgtagatattgggctgtttggacctgcattattaaaagatctcagtttatttaaagactgtgaacctgaaagcatttctgattggacttttgatgaaaactgtttattctgttgcttgagaagagataaagtaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacggtgagaactcaacagaggcaaaagcagtagattctaacaatcagtcgaagtccccactggagaaatttatggtcaaactgtgtactcatcatcaaaagcaattcattcgtgttctgaacgacctgtacactgaatctcaaccaggcactgaggacctgcagccttctgattcgggagcaatggatgtatccacttgcaatgctggctgtgcccagctcagcaccaaacataaggaaaaagatgctctgtgtctcgatatgaagtcttctgcttctgtagatttgttcgtagactcgtcagactctcacagccctctacacttgacggaacagaccccgaagaagcctcctcctgagataaaccctgtagatggaagagagaatgccttgactgttgtccagaaagattcctctgaacttccaaccactaaatcgaattctattaatagcagttcagtggatagtttcactccgggatacctcactgcatctaattgttcctcagtgaacttccaccacatccctaaaatcttggaggggcagaccactggacaagagcaagacacaaatgtgaacatatgtgaggatggtaaagaccatatgcagagttcagctttagtagaaagtctaattacagtaaaaatggcagctgagaatagtgaggaaggcaatacctgtattattcctcaaagaaatttgttcaaagctttatcagaagaggcttggaactcagggtttatggggaactcatctagaactgctgacaaagagaatactttacagtgtccaaaaacacctttgcgccaggatttagaggcaaatgaacaagatgcaaggccaaagcaagagaaccatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaagcctttcaaatttacagttaatggagaacaccgtaatttgagatgtcagaaaatgcatctcagatggagaagggaacttgcagagtccttctctgaggctaagggaagttatatattatattctggttgttccttgggttttaaacttggaaccaagcagttttcgtttttaaaagtacagtgccttatttatcctttttgtttttaaatttacaaaagctaaaaagctgatctatgtgattaaaggcttgtattttatacttgatgcacaagcacttgtactgtagccgagaagaccaccatcatgcacataaaaggagcttttcagcagccaccctgcagcatctgcccacgaacagatgcccttctttgcaaaccccagcagtgaacttccctctctgtcttgtttgtttgtttagatgatgtttgaaagctaaaccaaatcattttatggtatgcagaggatttataattataaaagattactatttctgttaccccctttt

SEQ ID NO: 70175 - DNA, 1048 bp, Homo sapiens
atagtgagggtaataatgacttgttggttgattgtagatattgggctgtttggacctgcattattaaaagatctcagtttatttaaagactgtgaacctgaaagcatttctgattggacttttgatgaaaactgtttattctgttgcttgagaagagataaagtaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacggtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaa

SEQ ID NO: 70176 - DNA, 518 bp, Homo sapiens
atagtgagggtaataatgacttgttggttgattgtagatattgggctgtttggacctgcattattaaaagatctcagtttatttaaagactgtgaacctgaaagcatttctgattggacttttgatgaaaactgtttattctgttgcttgagaagagataaagtaaaggtaactaagaagcctgtgaaacttttatttagtgtagtattttaaagttttcatcttttaaaacattgtgttactttgttggaggatttgtaggaaaaggaaggtatggtttcatacttagttatgaaagagtttgatagtaatcctgggttttgcaatttaagttatttccatcctgttgattagcctattaagaaacctatatcctaccatgcatttattgttgttattttgtttttttgcttttttgttttttttttattttgagacggagtctctctgtgatgcccaggctggagtgaaatggcacgatctctgctcactgcagccgccgcctcctgggttcaagc

SEQ ID NO: 70177 - DNA, 4765 bp, Homo sapiens
atggccgcggggggcagcggctgcacttcctcagcgggcggcggtggccggggagttaatcctcgacgcacgggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaa

SEQ ID NO: 70178 - DNA, 5349 bp, Homo sapiens
atagtgagggtaataatgacttgttggttgattgtagatattgggctgtttggacctgcattattaaaagatctcagtttatttaaagactgtgaacctgaaagcatttctgattggacttttgatgaaaactgtttattctgttgcttgagaagagataaagtaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacggtgagaactcaacagaggcaaaagcagtagattctaacaatcagtcgaagtccccactggagaaatttatggtcaaactgtgtactcatcatcaaaagcaattcattcgtgttctgaacgacctgtacactgaatctcaaccaggcactgaggacctgcagccttctgattcgggagcaatggatgtatccacttgcaatgctggctgtgcccagctcagcaccaaacataaggaaaaagatgctctgtgtctcgatatgaagtcttctgcttctgtagatttgttcgtagactcgtcagactctcacagccctctacacttgacggaacagaccccgaagaagcctcctcctgagataaaccctgtagatggaagagagaatgccttgactgttgtccagaaagattcctctgaacttccaaccactaaatcgaattctattaatagcagttcagtggatagtttcactccgggatacctcactgcatctaattgttcctcagtgaacttccaccacatccctaaaatcttggaggggcagaccactggacaagagcaagacacaaatgtgaacatatgtgaggatggtaaagaccatatgcagagttcagctttagtagaaagtctaattacagtaaaaatggcagctgagaatagtgaggaaggcaatacctgtattattcctcaaagaaatttgttcaaagctttatcagaagaggcttggaactcagggtttatggggaactcatctagaactgctgacaaagagaatactttacagtgtccaaaaacacctttgcgccaggatttagaggcaaatgaacaagatgcaaggccaaagcaagagaaccatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaagcctttcaaatttacagttaatggagaacaccgtaatttgagatgtcagaaaatgcatctcagatggagaagggaacttgcagagtccttctctgaggctaagggaagttatatattatattctggttgttccttgggttttaaacttggaaccaagcagttttcgtttttaaaagtacagtgccttatttatcctttttgtttttaaatttacaaaagctaaaaagctgatctatgtgattaaaggcttgtattttatacttgatgcacaagcacttgtactgtagccgagaagaccaccatcatgcacataaaaggagcttttcagcagccaccctgcagcatctgcccacgaacagatgcccttctttgcaaaccccagcagtgaacttccctctctgtcttgtttgtttgtttagatgatgtttgaaagctaaaccaaatcattttatggtatgcagaggatttataattataaaagattactatttctgttaccccctttt

SEQ ID NO: 70179 - DNA, 213 bp, Homo sapiens
gaaaggagttattttaggagaaataaaagaaagggctagttttgaagcaggtaggtcatagataagagctctggaattcagctccttctagtttttattccaagttctccagtgctgggagtttaagatcacaggcattgcatcttatcctatgactcagtttcctcatctgcacattggaaataatgacagtatcaacctcatagtgttgtt

SEQ ID NO: 70180 - DNA, 612 bp, Homo sapiens
tttttaaacaaccagctcttatgggaattaatagaacaagaacttactcactcccctgatcctagagaggatatcaatctattcatgagtgacttgccccccatgacccaaacacctcccattaagcaccacctccaacactggggatcaaatttcgacatgagatttggaggggtcaaaaaaaccaaaccttatggggtatgtgtattttttctaccctttttttcttttttctttctttctttttttttttttgagacagagttttgctcttgttgcccaggcagaagtgcaacggcgtgatctcagctcactgcaacctcgacctcccaggttcaagcaattctgttgcctcagcctcccaagcagctgggatcacaaggatacgccaccatgcccagctaattttgtactttcagtagagacggggtttctccatgttggtcaggctggtcctgaactcctgacctcaggtgatccacccaccctggcctcccaaagtgctgggatgacaggtgtgagccaccacgcccagcctaccctttactttttaaaagtatcagtatatcactccccatcagtatgtagagaatttcttcattcctttgtcga

SEQ ID NO: 70181 - DNA, 597 bp, Homo sapiens
ctctttatcccttgggactccttcctgtaatttgaaagggggggctaatgttggtggcagttgttgctaaggatctctgcacagagttagggcttcactctcggcttcctggttagatggggccatgtgactagtcctagtcagtgagctgtgaccagaagtgatgtatgtaccctcgggaccagagcatttatgtgctggtacaagcctctccataatgacgggcaacacatgagatggtggctgctgcagccatctgggtctctagccaacccaaaatggggacataacacaagcaagaaataaacatttgttcttataaatcaccaagattttggggttctcagtggctgcaacataacctagactatcctgatacaggcttatcaccatgttctggatgtgtggtgaccaggatggtagccactactcacaagtggctatttaaatttaagttactttaaaaaataaaataaaaaattcagttcctcagttgtatgagttacatttcaaatgctcgacagtcacatgtacatcacttttcaaattatgtgaaattaaaactgaaaagcttgtgtgaaagtctagagagtatgg

SEQ ID NO: 70182 - DNA, 475 bp, Homo sapiens
caccatatttaggagggggctaaatatcaacataatattcctacttctgcatttcctatttctctctttgcattttaaattcaggggaagttatctcatttattaattgtaacatttaaatagtatacatttctgtcatttaaaagtggtactgacaatgtagttaaacctttattatcttttattggtttaataaataaaagtgcatgactaaaaacaggccacaaatatcaatgattttggggatttcgccctacaggaaaatcatacaatgcatttggaaaaaggtaattctgacttgtcctctacgaaatgctaaatttctgcacaaaagcttaaagcacaagtgtttacaggattcttggtgacaagaaaagtgatagtaaatgtgctttagcactaaaattcatgtatccatggaaacctgtgaagttctgtaagcacacacacacggcctgcggtatttattgaagag

SEQ ID NO: 70183 - DNA, 250 bp, Homo sapiens
ggtgctcaaagaggcgatgtgaccggcctagaaggccaaaacccagagctgcgcctgggagcaccccctcctcccctttctctagcatcagaagcagcccagatccaacaagatcagggccaatggaggcaggacttcacccaaggcagggaccaagatggattggttctgcagtgtcccgggactccgtgggctacagaaggctccaccttgaggacaggcttgctgagtgaacgcctgctggtgacag

SEQ ID NO: 70184 - DNA, 366 bp, Homo sapiens
  misc_feature (142)..(142): n is a, c, g, or t
  misc_feature (243)..(243): n is a, c, g, or t
aactcactaccatcagacctgtcccccttactttcctttttttttgtttactttttaaaatttttttgaaatagagtcttgctgtgtcacccaggctggagtgcagtggcatgatctcagctcactgcaacctccacctccngggttcaagcaattctcatgcctcagcctcccgagtagctgggattacagatgtctaccaccacgcccggctaatttttctatttttagtagagacagggnttcgccatgttggccaggctggtcttaaactcctggcttcaagtgatctgcccgcctcggcctcccaaagtgctgggattacaggtgtgagccaccacgccccagcctactttcttgattgtt

SEQ ID NO: 70185 - DNA, 1600 bp, Homo sapiens
  misc_feature (798)..(798): n is a, c, g, or t
  misc_feature (1086)..(1086): n is a, c, g, or t
ggccaagagggagaaggggcctcccccaacactcagaggtgaactcgaacaacagtggtgaagggaaattctcagcatgagcctgggaagctgaaggttgggggccggaacagcctgaagtcttatttactcacatgaggggctgtcacatgggaccctggctgggcctcttgcctgaaacatctccctgtggcttctccctgtgggcagggcttcttcacagtgtgtcactgggttgcacaggtgagcatctgaaaagtgagagaggcaggcacagaagtcaggtgcatcactttgaccacatcctgttcattcacctgccaggttcaagggaaggagaaaaatcgtccacctgtaaatgggggagcacacgtgggaccagaaatattgctgcatcctcaatgggaaaatgcttctgcaacacggttgagagttgccaatattatcttcattttgccatcaacctgccacgtttcagggaattttctacttgtttggattggcaattttccaccttctctttttctcaaatataggttgcagaattcgagtcacaaatagcgtgagggcaaacaacgcgggcacagtggacttcagagaagcattaatgaaactttaaatcgcacgtggcctcaggatatcccacacagtgtctgtggcaatatgcaaatttgtggtatatgaaattaggagtgtcttatttcaaactccaaattggccttcaggaaattgcttctgaagttactgtattagtttgctagggctgctatagcaaaataaaacaactaggtgacctgnacagcagaaatttattttcttacaattctgggggctggaagtccaagatcaaggtgttagcagggtcaggtgttagcagggttagatcaaggtgttagaaggccctctcctgggcttctggatggcctcttcctctggtgtccacacatcgtcttccatctttgcatgtttctgtcttaatctcctcttcttataaggataccagtcgtactggattagaggccactctaatgacctcctttaccttaattaactctttaaagaccctgtttccaaatatggttacantatgagttattggggtggggggctttagaacttgaatatacaaatttgggaagacaaaattagctgcaataatcactgctatagaaagtcttatgacagtgaccttgtaggctactccggagtcacattttcatctgtcttctagacattttgtgtctgataatcttcctttcctcaatgcttcctaatcctgatttttctgtgtctgtttagaatatctcatcctctcaaggcatcaggacaaaaatgaataaataaaaaatagtaactaaacaaaaatctccagtgttaactataattttctgtctttttttttttttttgtatcctaagtcctcatgattattcctttgaagtaacttccatttttgtcccttcttacttctccatctcacttctggcttttctcatggtttttgtcttttatcagattgatacagtgtgttacattaatttgtttaaaacattaaaccaaccctgcatccttaggataaatcctactttttaatgtgctt

SEQ ID NO: 70186 - DNA, 306 bp, Homo sapiens
tgcctgtaatcccgggtactcgggaggctaaggccagaggattgcttgaaccagggaggcggaggttgcagtaagctgagattgtgccactgcactctagcctgagcagcagagtgaggctccatcagcaaaaaaaaaaaaaaaaaaaaagatcagagtgcatcacacataattaaggtagcttatgttttgtgaaactttgtgagtacgggttgtcatttttaatgtagccctaaatgttttttagggaagaaaaagttggcttttaataagtattcagtgagaatgaatttgaagggtgtggag

SEQ ID NO: 70187 - DNA, 374 bp, Homo sapiens
cagcgtaaagtaaccctgaaagaagatgctttgcctgaatcaagtttagcgtcagagcagccataatcctctgccgagattcttcagaactatgcagttggaggggtagaagccaggctcattctttcagggatggaatcaaatggtaattaaaagcaaatgattgccaaggtcgttagagatgccagagcctcaggatcagactcgtaagcaaatggaattggtctttctccaaaatcctgcactgatttaaccacaggatcgtaaatcaaaggggctgtctgaaaaccagacagccttccccaggctgtgcatctgaaatactcgatcccagcacatgtacagcaggggagctacacacgggagggagaaaa

SEQ ID NO: 70188 - DNA, 466 bp, Homo sapiens
aaacaatatttcctggcaattttaaagttagactacagtatgtttttgtatttgtagtataatatttagccccttaaccccttacaggcactcgaatattagttcttcccctccaccctggaagagtttccctttgtccacttgagttgaatatatgtgccgtactaaaggagaaaaactaccatctacccagttattgaagccaagatcttgaagttacaccagactctctaatttctcattttctgcatccgtcgatttctggagttcctcagtgatgcacactgggggtctcagggatgacagtttttcatgaccctaggttgaaactgggagtcatagaagacgaaaaaacgagaattggattgggagttgactctgttgcccaggctggagtacggtggttgcagtgagccgagatcgcgccacttcactccagcctggggacaagagcgagactctgtct

SEQ ID NO: 70189 - DNA, 312 bp, Homo sapiens
tttgcattcaaataatgcatcttatcggtcacttggaactcctttttttcaaataaaaaggaaagaataatttagtggtttgccgtcctgatcatgtcttagactcatctgggagacttaaaataggctgatacttggaatctaccctctgagaatctgatccaactggtttgggctggggtcttgttgtcagtgttatttttaaagcccagtgatttttaaatatataatcagtagaggactgcctatctaatttgaaatagtaaataaagaagagctaaagaaatgaatgcatctcatcattgtgtctca

SEQ ID NO: 70190 - DNA, 110 bp, Homo sapiens
tagaatactattcttccagaagtctattagaaaatcagaaaagcaaatcgtaccttcaacaattgagaaaacaaaaatgctagttaaaaaaaaaaaagtagagggaagga

SEQ ID NO: 70191 - DNA, 319 bp, Homo sapiens
tgaatccttgtctgtacagacacagagaaaagtgcatggatggctgcaaatctggatcaggcatatggaagatgaggcatagccacaaatgctgtgcaccactaagtagaaaatttgctgagaaccaagatgcaatgaggatgggtgctataagaaattagaagaagggggagatcagtgaaaggatcagggaaaccttcacagagaaaatggtatttgcaggatggatatgattttaacaagccagtctaaaatggaaagtaacagaaggctaaaagactgcatgaacatatgtaataaatatgttgagatttggcca

SEQ ID NO: 70192 - DNA, 355 bp, Homo sapiens
ggagaggccctagttctgctcagaagattcaagtccatattcagggaggggtcactgtccacacccccaggtccaagtgagggatggtaggaggagggaggcgaggctggggggccccggctcaggacaggatgggggacaagcaagcaaagcaaaacatgactccacatcagcagaacaaagacaaacacaagtgttactatgaaaatccgcatacataaatattaaataatagaacctaataaaagacagatcccaaacatgaaaggttattttgttactgtaacttactaaactgacttaatctaataaaaatactatttcttcatagtagtcaggtaacaataaaaaacat

SEQ ID NO: 70193 - DNA, 339 bp, Homo sapiens
tcttaaatcttttttaaagtagtactagctcatggaggatttggaaacttacgtagcacaaagaaaggagagagaaaagagtgtgtatgtgtgtttactcagtaaatatttaacaaatgagtgaatcacaattgaattaataattaattcaattaatattagtaatattctttcagactctgcaaacgcatataatcctattttttaaaagagaaatggtataatactgtacgtcatgttttgtagcttgctcttttcacttcagggtttttctcaaacatttccatatgataaacatgatctctattatcatgctagtgttttcatagttttttaatt

SEQ ID NO: 70194 - DNA, 3486 bp, Homo sapiens
  misc_feature (2968)..(2968): n is a, c, g, or t
gttcaagacactctctctgagtagtgctttaccattttgtggagctttcacttacattatttcacttaccatggcaatcaaggtgtgtcaactttatatgtaaggaatctgttcatccgatacactattcagtcttgttccaagactgacttttatttcagaataagattctgtcctgttctttttgtttcttcatgacatacattatcagtttttctgtttattgattgttcatttattcattcataatcttattgaatacctcctctgtgctacccataatacacacttctagggatatagtggtggacaaggctctggtttttatgagttttatgtcatgttcagttgcattccttggtgatttttgtgtcgtagagagcagatatgaaggaagaaatcaataaaataagagtacagcaaaattaaaagagaaaatgttatatatcagttgaaggatttaaatacatgaatttatggagcaaatacctgtacataaaaaaactttgaaaggtaatagtagaaaagtagtatggtgaagtacaaaatagagtgtaactcaattatgtcagccacaggtgaattactcagtcctttaacaaagatttattaagcctataatcctaggattattagtaataaaatgagtgtggggagaaggatgggctcataagatcaattcttgcacctcccatgaccatagctgggtgctccacctgctgtattcctaagtaaaggcaatttgcaggccattctaatttccttttaagtaccccacaaatccttcatgaggtggattgctgccaatagcattctataacatttgggttgagtggaagatgtcttagtagtattgctttgaataatttcatacctataattaaaggcaagaggctatggagcttttaagaaactaatgttacacaccgcatgaggtcattgaaacatgagcccaggagccctatagataagtggcattcagtatatgccacttaaataccaaagcaatgaagtgcattggtcttacttaatacagtgtgggcagaggccttaaaaataaaagaggaactaattttcttatttcaaaatgaaatgcaatgggacaattttactcttaaaaaactgcatactgggtgtcagcatgaacatcatactttctataatatcattgacaactgcctatcaacaccaagcagctatctctattctttgctgggtaagcaacaaatgaatgtaataaatggttatgttacaggtttatttcaatgtagtttaagccataattttggagatacagtggaaataagtgtattaaaatgtgagataaaatatgtcttacaaaactatttagtaattggacaactgtctgaagaccttgagtgtcatttgatgaatcagacacttcaacaattgatttctggggttgggatgctgaggattgagcgtgacattttcctcctatttatttctgttttcttaggtcagggaacacgtttcagaaccatgtctttagaataatagacttaggattgggtcacaaatttgaagttggaatggaaaaatgttatttgttcattcatcattaattcatttaagaagcacttgctgatgctttgttaagtagtgttccaggcactgcattagaccctgaggacacagtggtgagcaagactttcagttatggagagagtgctctcagcactccttggcagtgtgtacctatgggatagatctgtgatctttctgaaagatggggcagtggctgttaatgacatcttgtttgggagataatagtaagtccatgatgttgatagagggttgaatcaatctttcctggcactgtcacctggaagcccagacttagtaatgtgtaataactcattcaggcttcaaacaggaggtttccctgcccggtgtaacatacagtgagaatggatctgagaaaatccagatgctgcctgagtaaagtgctgaaaatgccaaacagggcccaaaggaccttgcatgcacccttagaaataaggctttagaaccagagcagacacagaggttggagaatctactttccacagaagtacttgtaggagctctccctaggaagacctccccactccacactttattagcaaattcctgacatttcacttttagaattttactcagactgaagttgaaggatgttagaatgcaaatgcacataattcagagcagtaaccccatagcatgaatgaggttttagattcttcctgaaagtcatatgggtagagggagcaatgcagactcgtagggcccttagtacatgatcagggttggcaggttttgtaaggaaggctttttttttttatctgagctggatagtcaagggcaggaaaccaggtttcgcctattccactgttgtgtttggcatgaacacagtcttactggcctgtgagagagttgtggttttctaaggcagcttcaccttagaaatggttatctttgatccaagatctatttatgtctatactgttctatttatgtctagactgttgcttatgacacctccttgctgcaaatcattgacttgctgtgatgtgactaatttatgttttttcttagtttgatttgaaatttcctaactggaaaaaaaaagtttgtggaggaggcagggaaggaaaaataaaagaaaaacttgctaattttctttgattggaaaaatatatttcttctagatgttctaagaatgatggcataatttagtactttttattgataatttggcagaaagcttaggatgttcataggtttcccaaaatatcttctgaaagataactaataactggtacttaatccagcatttaccatgtacccgacattgtgccaaaactttacattattaaacccatttcacacagggagaagctgaggcttaaggttattattaagtaatctgcctcaggtcacatagctagtaaatgttggagtgaangttcaaacccaggttttctgatattcaacccaccctcttgtcaataactctataggatgttagtaagatttagagtgaaatgagtcctatggtcagacaggcctggaaaacactgaggtaagagtgagtttaacaggtcttctcctaatcctctactgtgcatgagaatctttaagaagaagaatgtaatatgcagcattctccaaactgatttcaccaaggaacccctttcttcatgaagctcttgccactgtactgtgccagaagatctgttttagaaaatgcttccttgggacctgtttccttcgaattaaagatgttgctgaccatttggagttatgttttatcaccagataaacagttttcacccaacaaattatctactaaaggccaaaaccttttacagaaatctcttctttatatctatgtttccctttcgtctattctatcttttcctttcatctattttctacacccttctattaactgtatcataaaataaaattcacttgagccct

SEQ ID NO: 70195 - DNA, 606 bp, Homo sapiens
gtcgtggtttttgaagtttagtggtctctcctatccctggccaaggaagtatgcaaattgtattgtggtttttgaagtttaggtgatctcttccttctatccctagccaaggaagttcatcctgactccccaacaagcatatcaaaaggagtgtttcgtcacctttttcctcttaccctttacatccttttagcaataaagtgttcagaacaaactggttttcctttactgtgctttgcaaaacttattcatgttttattgggtgactttgtatttacactttcctcagatagtctgttgtcagatgactttgaccaatgattgggaggaaccaaatacagaggattttatcctatgcctaatctatattgtctacagagtaaatcaggtatgaatttgtgaacagtaatgaaacaattttccaactaatcagaagaattgtttgttaagtaaccttaattactcagtttttggtgaattgtttgcggcttaacttgtaaataatttcttattctttttttaaatgtatgaaatatttctagttattttgttcaatgtgactgataaaagtttatattggaatagctgtgaaatggaaaaagtcta

SEQ ID NO: 70196 - DNA, 1385 bp, Homo sapiens
ggcagcccttttctagatggagaaaacagaacctgaagacacccgtttccctaaactgctctcgctcatgtttctacaaggcctggagctgataggaaaaacctcccttctttcccaaatggtccccagctgccccgttcactgaaggccctgcagtcaggaacggtcaggacttcacacccagttgttgtgggtgtttggccgacacgacacttcctcttgtgtgattcatggacccgcagcattgcgtcacctgggagcttttggtattgaagactctcagggctcacccggaaggacctgctgggccagaatctacattttaacaagatgcccagaaactcctggagggcagaggcatgcctgccatcttcatcattgcattaccaccacccaacactatcgggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacccataaaagatctgtgctgaggtggattagtcaaagaggaaagacttgcagttgagatagaggaaggccactgtctcctgactgcccctgggaactgaatgtctcggtataaaacacgattgtacatttgttcagttctgagatgggagaaaaaccgccctatggtgggaggcgagacatgtttacagcaatgctgccttgttatcctttactccactgagatgtctgggtggagagaaacataaatctggcttacatgcacgtccagtcatagtaccttcccttgaacttcattatgtcatagattctattgctcacgtttgttgctgaccttctccttattatcaccctgccctcctactacattcctttttgctgaaataatgaagataacaatcaataaaaactgagggaattc

SEQ ID NO: 70197 - DNA, 1336 bp, Homo sapiens
tgtgtctgttattccctggcagttctacaaggcctggagctgataggaaaaacctcccttctttcccaaatggtccccagctgccccgttcactgaaggccctgcagtcaggaacggtcaggacttcacacccagttgttgtgggtgtttggccgacacgacacttcctcttgtgtgattcatggacccgcagcattgcgtcacctgggagcttttggtattgaagactctcagggctcacccggaaggacctgctgggccagaatctacattttaacaagatgcccagaaactcctggagggcagaggcatgcctgccatcttcatcattgcattaccaccacccaacactatcgggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacccataaaagatctgtgctgaggtggattagtcaaagaggaaagacttgcagttgagatagaggaaggccactgtctcctgactgcccctgggaactgaatgtctcggtataaaacacgattgtacatttgttcagttctgagatgggagaaaaaccgccctatggtgggaggcgagacatgtttacagcaatgctgccttgttatcctttactccactgagatgtctgggtggagagaaacataaatctggcttacatgcacgtccagtcatagtaccttcccttgaacttcattatgtcatagattctattgctcacgtttgttgctgaccttctccttattatcaccctgccctcctactacattcctttttgctgaaataatgaagataacaatcaataaaaactgagggaattc

SEQ ID NO: 70198 - DNA, 990 bp, Homo sapiens
aaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagt

SEQ ID NO: 70199 - DNA, 210 bp, Homo sapiens
gatgagcccagtggactttggctggggcagcctggctggccccagttgtttctaggttctcagaggagaccagcctggagccctctgctgggtgctggcacccacttgtccctgggccaagcagatggtgggtatggactcacatggacgtgtgggctccatgggtgcaggcctcccaccagcaggccagggagagggggaggttgaaat

SEQ ID NO: 70200 - DNA, 2174 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70201 - DNA, 659 bp, Homo sapiens
gatgtaacagaaggagaatcatctgctttggttcatcctggatcattgagccatgatgttgattgttggatgtcaagagtagataatgttgatgactaatggaagagtagtttatacagcgtggatacgctgggcgaagagatggttcacattccacttggagcaggatggtgcaagatttcatcacacttctcagaacaacacacagtttaaaacttaatgacttttttatttctggaatttctcatttaaaatttttggaccacagttgactgcaggttgtaaagctctctgaaatagtgaccttagcgaagcaagcacatgtggatgtgaaatttcagttgccaatatgatctgaaaacccagtggatggctgaaggagttgattgaccaccagttgagagcctgcagttcatcagttgagagtgacaattccagagtgaccagctgagcatgtaatatgaaggaaactggagaaaagcctcaactactttatgattattcctatgatttgttcttaaagcagagaagcatctttttatttgtttttgatatccttgtttgatgaaaccagcatcgttttagaaaaaatatctttgttttagtaaaaatgacacatactcattgaaaaaataaaccccttcaaaactggaatgata

SEQ ID NO: 70202 - DNA, 495 bp, Homo sapiens
cagcctcctgaatagctgggaccacaggtgttctgggactcagtgttagaagctgtctgtctgtaagaatcttgctgtctctgcctcatgaaaacaattgcagtgatgagaaccagttactaatggcatacatcacacatttcagcccatcttctgggtgagcaggtggttgagctgtccctcgcctttgaatcaggaagttagcatcaaaaatgaagatgaaattcccatgtgaaagacacccttcctatactagaaggaaaagcaacatctgtatccttaaggacgagaagccaaggctgaaagacttctttacagaccttgttaagataactcatattgttgaagtctccccacataatttagttgcttcttcacaacttagtattcttttgtccaatgcagtatataagtaactgactgtagctggttttttgggtcttattttccttatgagggctccccaggccacataaaacttgtattaaatgaatt

SEQ ID NO: 70203 - DNA, 377 bp, Homo sapiens
gatgcccatgaaggggaaaaataagcaggcaaaaaccaaaaaacagaaaccaactctcaaaactccagcagaaggcaatgaagctgttaatattttggagttgattgaccaccagttgagagcctgcagttcatcagttgagagtgacaattccagagtgaccagctgagcatgtaatatgaaggaaactggagaaaagcctcaactactttatgattattcctatgatttgttcttaaagcagagaagcatctttttatttgtttttgatatccttgtttgatgaaaccagcatcgttttagaaaaaatatctttgttttagtaaaaatgacacatactcattgaaaaaataaaccccttcaaaactggaatgata

SEQ ID NO: 70204 - DNA, 369 bp, Homo sapiens
ctggcttgttctgttttgcttctgagacatactaagtaccgatcggtagaaagtgaaagcaaatgatggcaaggacacctcataaattaaagatgaaattcccatgtgaaagacacccttcctatactagaaggaaaagcaacatctgtatccttaaggacgagaagccaaggctgaaagacttctttacagaccttgttaagataactcatattgttgaagtctccccacataatttagttgcttcttcacaacttagtattcttttgtccaatgcagtatataagtaactgactgtagctggttttttgggtcttattttccttatgagggctccccaggccacataaaacttgtattaaatgaatt

SEQ ID NO: 70205 - DNA, 2720 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatgaaaaaaaaaaaaaaaaaaaaaaaaaaaaaaaaaaaaaaaaaaaaaaaaaaaaaaaaaaaaaaaaaaaaaaaaagaaaaaaaaaaaaaaaaacaaaacaaaaaaaagagaaggagcggcgcgagcacacataaacaaactaccaaacgcggggagacaaacatagacacatccacacaagcagcgtctataaatacaatacagaggggcatcagcaaggagacggtcgtcaatcatcgagagagacgagggaggagagcgacagaacactcggagatgtcgggagagggccgagccgacaaaaacacagcagtcgacataggcaaagggtctagagtaataatagaagaaaaaaccacgaaacactatttatctttatcaggtgagaaaagaaaaagaattaatagtcagaggagacttaattaatcagaaaaaattataatgaagtacttttgatgacggtgtattacataaaattattgtatgtgggagtttaagatagtggagaacacaataaactagtaatagttgtttaataaaaaaaaagag

SEQ ID NO: 70206 - DNA, 2056 bp, Homo sapiens
  misc_feature (16)..(16): n is a, c, g, or t
aatcaaagcgagagcnctcggcctctccagctgtccgcggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70207 - DNA, 2271 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggtacagaagaaagaaataatatgtgcaggataaactgtaactatgagtatttctggcaagttctctgggaccagaactcacaagtaataagaagcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70208 - DNA, 1730 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcagggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70209 - DNA, 2106 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctaggtaccatgtgtttttatgttagaattggattcactaagtttaatttggatttactaagtttaatttattttctctgtgtttgttgcttatacaaatcattttcccctatatagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70210 - DNA, 1068 bp, Homo sapiens
gatgtaacagaaggagaatcatctgctttggttcatcctggatcattgagccatgatgttgattgttggatgtcaagagtagataatgttgatgactaatggaagagtagtttatacagcgtggatacgctgggcgaagagatggttcacattccacttggagcaggatggtgcaagatttcatcacacttctcagaacaacacacagtttaaaacttaatgacttttttatttctggaatttctcatttaaaatttttggaccacagttgactgcaggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70211 - DNA, 1508 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaagtgagtaattgtagacatgatacatacgggataaatttatgacattcaatttcaaaagtccattattgtttctatttatgtgggaaagattttaaaagtacaaattataatctgtttgtatgtcatgagcatgatatttatgtcatttaaaaaacagcttctttaatgccgtaaaatttgatatataatatcatgatcttaaaattataggaaaaattctgctgtaataaatttcatgggattctcaaattgttaattcactaaaagcagcttaaatcatctctggatcatctccagattgagaaaattatatctagcatagtaaaatattctaatgaaagagaaagttgctgaacccactagaagaatgtgtatccattgcctcatcttctgttttctcaacttcttgggtttgtttttttttttttaatagtttggggtttgtttcactatatgattcaatatttggtaaattgagggatgacattaagtagcaaacaatatggttttaaggagtattacattagcacagctctcctctctttatggaacctaaaatgttgaacataaagcttctggtgaagagaaaatccctttatagacctggtgtttggaagagagcattgataatcattttatactagaattatctgtttttcgagggtattaggttttacaagctgaatctgtgtgttaactagcttgttttttgaagcaactgggtatatatttgaaagccccagtacggatttcatgtagaacattaattgtgtagaatttagagtaacaaaaattttaagagtcatgaaaataattttcttatgtagaacaactttttaaaaaatagcaactttctgtattgtgatttttcttatttacaattaaatctattaatgtttgaatgata

SEQ ID NO: 70212 - DNA, 2107 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccacaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70213 - DNA, 2287 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctaggtaccatgtgtttttatgttagaattggattcactaagtttaatttggatttactaagtttaatttattttctctgtgtttgttgcttatacaaatcattttcccctatatagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70214 - DNA, 2120 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatga

SEQ ID NO: 70215 - DNA, 2114 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggtgttctgggactcagtgttagaagctgtctgtctgtaagaatcttgctgtctctgcctcatgaaaacaattgcagtgatgagaaccagttactaatggcatacatcacacatttcagcccatcttctgggtgagcaggtggttgagctgtccctcgcctttgaatcaggaagttagcatcaaaaatgactttgtggttagaaagacctggatttcgattcaagttgtgttagttaatagctgcaagacttcagaaattggtttcctttgtgcatacgtctgcactttcacatatacccacgtgtggtcagctgaaaaatgactcctcgaaagatattcatatcaaactcctggcagctatgaatgtgactttatttggaaaaagggtctttgcaggtgtaattaaatgaaggatgttgagataaggtgattatttgggattgctcaggttggccctaattcgaatgatgaatgtctttatgagagaacggcagagggagatttgagacagataggagtgaaaacacagagaggaggaggaggcaacgtgaccatggaataagacattggagtgaagtagccacaagccaaggaatgcctaaagccaccaaaagctggaagacgcaggaaaggagcctcctggagagatttctgagggagcacagccccaccgatgccatgatttcagccttctggttcccagaattgtgaaagagtaaatttctgttgt

SEQ ID NO: 70216 - DNA, 1187 bp, Homo sapiens
gcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcagtacaagcattagctatctcagtaaaggactgctatctggcacattttgagga

SEQ ID NO: 70217 - DNA, 4898 bp, Homo sapiens
gcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70218 - DNA, 4523 bp, Homo sapiens
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70219 - DNA, 2098 bp, Homo sapiens
gacccacgctgtcgcggacggcgtgggtcgacccacgcgtccgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70220 - DNA, 1854 bp, Homo sapiens
ggcctggtggcgaattcggcacgaggccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70221 - DNA, 4605 bp, Homo sapiens
  misc_feature (4575)..(4575): n is a, c, g, or t
  misc_feature (4582)..(4582): n is a, c, g, or t
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttaaaaaaaaaaaaaaaaaagttctttaattaaaggcggccgaaagcttaattnccctttnagtgaagggttaattttaaggct

SEQ ID NO: 70222 - DNA, 3196 bp, Homo sapiens
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgcc

SEQ ID NO: 70223 - DNA, 1825 bp, Homo sapiens
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaaggtgagcggctgcggccttcgagaagctgtggcgaatgctaaacaccccttcttccctctcaagcaggtcaaaaaggctgggcctggatcttgtaagaattggtttcctgcagtcaccttcccaacagcagtgctggggtgagctcacccatgtctgctggggactgaatgccacttctgttgcaggtctgcctcagtagatgctggggaccaatatagggccttcctacctagtctatgacttagaagggcagagggtgaggggaaaagggtcccatcagc

SEQ ID NO: 70224 - DNA, 1102 bp, Homo sapiens
gcccgaaacccggaagtgagcggcggcagctgcgaggctcggagaaacaggcgccgcgggctccgcgcccggccggacccgggcccgagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggtgagctgggcccagccgagagctccctcccctgccctctcatgggacctaaggagagggctcagcacaggcatctccattgtggggagcgcttggctggcctagaagctgggagtgcccattttatagctgaggagatggaggccctgggggagcaccttgctgcaggggcagacagagccgtctcccacccctgggtcactcagctgcccatggtcagcctggcccctgcccctgggggagcccagtgcccgcggcgttggatgcagtcagcggcgttggatgcagtcagcggcgttggatgcagtcagcggcgttggatgcagtcagcggctttggatgcagtcagcggcgttggatgcagt

SEQ ID NO: 70225 - DNA, 365 bp, Homo sapiens
ggccctgggtgctggggcgtggggagggggagccggtgagccttcgggcctggcgggcagtaaacgtttctggaactgactcacttgctggggaggggcagccagggagggtcacggagaaagtccctgcccgccatggccccggaccgccgtcggctgcccgtccagcctggagtgaggaggcgtcttcctttgcatgtcaggtaaactgaggaaagctgcctctggggtctgctgcgctcgccgcctggcttccggtgcccaggggccgggtggaatgggtcgcgggacccacgctggtgaccgcagcctccctacgctgtgagagggccaggcttcgtggggacagacagccgccagggtgc

SEQ ID NO: 70226 - DNA, 716 bp, Homo sapiens
gcagatcggactggcgggcctggtgccgctgtctcagtgacctgctttgtgactcgtgcccgtgcttcccggagccttgtgattgacctccatccccagcaagaacaagcgtccaagtgaaaccgaaagaggcggccttggccttggttccaggccccgctgcgttttgaaagtgatgtgcgccaggttccggaaggcggctcactcgcgtttcctgggagtctctgccgctgtgggctcctggggccaaggccctgggtgctggggcgtggggagggggagccggtgagccttcgggcctggcgggcagtaaacgtttctggaactgactcacttgctggggaggggcagccagggagggtcacggagaaagtccctgcccgccatggccccggaccgccgtcggctgcccgtccagcctggagtgaggaggcgtcttcctttgcatgtcagatcatgatgctgccgccaccgccgccaccacggagcgagaagcccagatagacgccccggcggccccgggtcctggagtcccgccgcctgctgcccggccgaggaccccaccccgcctgccgcccgatgcttgcagtggggcccgccatggacagggattacccgcagcatgaacccccgccggcgggcagcctcctgtacagcccgccgcccctgcagaagcgcatgctgactgcctattggaaactttccgtgcgcatacg

SEQ ID NO: 70227 - DNA, 4605 bp, Homo sapiens
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtggggtcgggcggggttacccccccagaggagggcccgcggggggcggaccggggcgcggcctcaacgcccccctccgcaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70228 - DNA, 2047 bp, Homo sapiens
caggggtccagggaaagccagcctcctccctgggcctcctccccgagtcaccttctccccctagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaatgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70229 - DNA, 1411 bp, Homo sapiens
gcggccgccgggcgcagctttcgctcgggttgccggccctgaccccgcccaggctcatgcggccctgtgtccctaggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctgacacgcctttaggcgaaacatgccccaagacacagggaccgtttctcccctaggagcagcggtggggagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctactt

SEQ ID NO: 70230 - DNA, 2063 bp, Homo sapiens
ctgccgcggtcatgagggagccgctcccgggcagcgcttcctgggggacccctggccccccgagcgccgggaccatgtcccagctgcagctgtggctgcagtttgaggctctgaacaaggactcctcctattttgaggacttctccaacatctccatcttctcctcgtccgtggactccctgtcggacatcgtggacacgcccgacttcctgccggctgacagcctcaaccaggtgtccaccatctgggacgataaccctgccccctccacccacgataagctgttccagctcagcaggccgtttgcaggcttcgaggactttctgccctcccacagcaccccgcttctcgtcagctaccaggagcagagtgtgcagagccagccagaggaggaggacgaggctgaggaggaggaggcggaggagctggggcacacagagacctacgccgactacgtgccgtccaagtccaagatcgggaagcagcacccagaccgcgtggtggagaccagcacactgtccagcgtcccacccccagacatcacctacaccctggccctgccctcggacagcggggccctgtctgccctgcagctagaggccatcacctacgcctgccagcaacacgaggtcctgctccccagcgggcagcgcgcgggctttctcatcggcgatggggccggcgtgggcaaaggccggacggtggccggagtcatcctggagaaccacctgcgcggccggaagaaagcattgtggttcagcgtctccaacgacctcaagtacgatgcggagcgcgacctgcgggacatcgaagccacgggcatcgcggtgcacgcgctcagcaagatcaagtacggtgacaccactacctcagagggcgtcctcttcgccacctactccgccctgattggggagagccaggccggtggccagcaccgcactcgcctccggcagatcctggactggtgtggggaggcctttgagggcgtcatcgtgttcgacgagtgtcacaaagccaagaatgccggctccaccaagatgggcaaggctgtgctagacctgcagaacaagctgcccctggcccgcgtggtctacgccagcgccacaggtgcctctgagcctcggaacatgatctacatgagccgcttgggtatctggggcgagggcacacccttccggaactttgaggagttcctgcacgccatcgagaagaggggcgttggcgccatggagatcgtggccatggacatgaaggtcagcggcatgtacatcgcacgccagctcagcttctccggcgtcaccttccgcatcgaggagatcccgctggccccagccttcgagtgcgtctacaaccgcgcggccctgctgtgggccgaggccctgaacgtgttccagcaggcggccgactggatcggcctggagtcgcgcaagtccctgtggggccagttctggtcggcacaccagcgcttcttcaagtatctgtgcatcgcagccaaggtgcgccggctggtggagctggcccgagaggagctggcgcgagacaagtgcgtggtcatcgggctgcagtccacgggcgaggcgcgcacgcgggaggtgctgggggagaacgatgggcacctcaactgcttcgtctcggccgctgaaggcgtgttcctgtcgctaattcagaagcactttccgtccaccaagagaaagcgggacagaggagcgggcagcaagcggaaacggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccaggccgcggagctggcagggtggcgcctgcggtttctatgtatttatagcaagttctgatgtacatatgtaaaggacttttttaaatatatgtgccttttgcctactt

SEQ ID NO: 70231 - DNA, 3116 bp, Homo sapiens
ctaaagtttttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacggtggacagttactattgcacttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggtctgccctgagcattctgactgtgtcaactccatgggaagctacagttgcagctgtcaagttggattcatctctagaaactccacctgtgaagacgtgaatgaatgtgcagatccaagagcttgcccagagcatgcaacttgtaataacactgttggaaactactcttgtttctgcaacccaggatttgaatccagcagtggccacttgagttgccagggtctcaaagcatcgtgtgaagatattgatgaatgcactgaaatgtgccccatcaattcaacatgcaccaacactcctgggagctacttttgcacctgccaccctggctttgcaccaagcagtggacagttgaatttcacagaccaaggagtggaatgtagagatattgatgagtgccgccaagatccatcaacctgtggtcctaattctatctgcaccaatgccctgggctcctacagctgtggctgcattgtaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccatgtggactaaattcaccaaggaagagacgtcctccctggccacagtcttcctggagagtgtggaaagcatgacactggcatctttttggaaaccctcagcaaatgtcactccggctgttcgggcggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttccaagaccaccaggctcccttgaccacctctgagatcaagctgaagatgaattctcgagtcgttgggggcataatgactggagagaagaaagacggcttctcagatccaatcatctacactctggagaacgttcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagacgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggccgtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcgtgcccctccagcgcctatcatacgcctgacacagagaacctctcaataaatgatttgtcgcctgtctgactgatttac

SEQ ID NO: 70232 - DNA, 4198 bp, Homo sapiens
ctaaagtttttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacggtggacagttactattgcacttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggtctgccctgagcattctgactgtgtcaactccatgggaagctacagttgcagctgtcaagttggattcatctctagaaactccacctgtgaagacgtgaatgaatgtgcagatccaagagcttgcccagagcatgcaacttgtaataacactgttggaaactactcttgtttctgcaacccaggatttgaatccagcagtggccacttgagttgccagggtctcaaagcatcgtgtgaagatattgatgaatgcactgaaatgtgccccatcaattcaacatgcaccaacactcctgggagctacttttgcacctgccaccctggctttgcaccaagcagtggacagttgaatttcacagaccaaggagtggaatgtagagatattgatgagtgccgccaagatccatcaacctgtggtcctaattctatctgcaccaatgccctgggctcctacagctgtggctgcattgtaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccatgtggactaaattcaccaaggaagagacgtcctccctggccacagtcttcctggagagtgtggaaagcatgacactggcatctttttggaaaccctcagcaaatgtcactccggctgttcgggcggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttccaagaccaccaggctcccttgaccacctctgagatcaagctgaagatgaattctcgagtcgttgggggcataatgactggagagaagaaagacggcttctcagatccaatcatctacactctggagaacgttcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagacgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggccgtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcgtgcccctccagcgcctatcatacgcctgacacagagaacctctcaataaatgatttgtcgcctgtctgactgatttaccctaggataaagactctttgtgattttaaagaaatggtcagtaaaactgtaatgagagtcccagggaaccaagatggcacatagacagataagctactttggcacaaacacttaaaaatagttgtgttggtaagtagggggatgtttgatgtagcaaaattctagcactccctggagggttgaagcacttggtgacaacaacctttggaaagtgctttggtttcctgaggtccttcaggtaaccaagacctcactgttttctagaaactttctaatgacttggctaggatttaggattttctctgtcacagttatcgctacctatccttaatttttttttttttttgacagagtctcagtctgttgcccaggccagagtgccgtggcatgatctcggctcattgcaacctctgcctcccgggtgcaagtgattctcctgcctcagcctcacaagtagctggactgcaggcgtgcaccaccacgcctggctaatttttgtatttttagtagagatggagtttcagcatgttggccaggctgatcttgcactcctgacctcagatgatccacccgcctcaccctcccaaagtgctgggattacaggcatgagccactgcgcccggccaccatccttaaattcttgagcttgggagagaagaagatgaaggtttaaatgcaggtattttcacttctatgggcactctaaaacctcccaatccaaagcgtggtccctggatcatcagcatcacctgagagcttgttagaaaagcaaagaagaatctcagaccccactccagacctcctagatcaggacttgcatgttaacatccccaggggatgaatataaccatgggtgtctgaaaagcactattgtagaacattcttctgtttgccgtgctgacagcagagcttgtctttaaagccagagagaaatgtcttcttcttgacttggaccctttgcatcttctcttagaataacttccctgaaaactcaattgatgtcttctgtctctttgagttgcagtgtagtcatcccctctgctaggaagcattctttgaatctcctacagtagaatttggca

SEQ ID NO: 70233 - DNA, 370 bp, Homo sapiens
ggcatgatctcggctcactacaacctccacctactgggttcaagggattctcctgcctcagcctcccaagtagctggcactataggtgcatgccaccatgcccgggtaataatttctgataaaattataaatacacttacaatatgacccagtaattctactccagggtatctactctggagaaatgacagtgtatgtccacacagagatctatacacacatgttcatagcagcattatttataatgctcccaattaggagtgacccaaatgcctttcaactggtgaatggataagctgtggtgtatccagcagtgaaatactactcagcatccaaaaggaacagacttctgatgcatgcaacagcatgg

SEQ ID NO: 70234 - DNA, 1151 bp, Homo sapiens
aatgtgtcatagctccggctggcagtgactagtctttggtcatgttctggagccacctggtttgcacacgtgtcgttttcaccagcaagtactatttttatggctgttcaccatttggctctacagtacaaacacttgcctgcttcgtcttttaacatacgtgtgtaatgccccggtgggattcgtggctgtaaggacgataagaaattgcactggccatgtaggggaagctcgacatgaattatgtagttcatttaaaatgcacatcaaagagagatcactttgtttaacataagtgaactctcccttcaattagatacaacagttactgaactattaatatgtatacaagaaaattaatgtggttggattcttaaggaaagcattacagtatattaaaggtgtaaattcaaagagactcatagttattgaatacactaaaatagttaatattttaggttaaaatgtaaacttatcacctaatttaataatgatgttatactaaacacacacatacaagtatattaagattaaattaaaagaatttgctgcttgccccaacaaatatttgcttctggaagctaagactatgaaacaactatttacttacataaatcaagtgaattcttcaagatttctttcaagacattgttctgtgcctcccaatccaagctaggatgtgataaactaaactccacccatagataaacttcaccctacaagtttaatcccagaaccactcagccgagcctgtcaaacctcatgaatacctttctctaatttcctcatattgagaaactgctaagactctattaaggtagcattctaccttttagtaattctaataaatttagtttcttggccgggcgcggtggctcacgcctgtaatcccagcacgttgggaggccgaggcgggcggatcacgaggtcaggagatcgaaaccattctggctaacacggtgaaaccccgtctgtactaaaaatacaaaaaattagcctggcgtggtggcgggcgcctgtagtcccagctactcgggaggctgaggcaggagaatggcgtgaacccaggaggcggagcttgcagtgagccgagatcgcgccactgcactccagcctgggcgacagagcgagactccgtctcaaaaaaaaaa

SEQ ID NO: 70235 - DNA, 330 bp, Homo sapiens
  misc_feature (212)..(212): n is a, c, g, or t
  misc_feature (238)..(238): n is a, c, g, or t
  misc_feature (322)..(322): n is a, c, g, or t
gaggagactttgcaagagataagactgagatgccaggcctggaccaaggggcctggtatgcctccctgtgagcttcgaatttttgtcctgtaggtgtggggaaccactaatgggctttaaactggggctcacagaagacacattttaaaagatctctcagatgaagtgtagaaggtagattagagagtcatgagaacggtttcaccatgttngccaggctggcatttacatatttttnagttaaaataaaattctagctagatgatgacatgtgcctgtaatcccagctactcaggaggctgaggactgtagggatggcttnagcccagg

SEQ ID NO: 70236 - DNA, 393 bp, Homo sapiens
aaagaaaagagaaaattgcagagaagataagtcttttctctaacagttcccaaaatccgtaactgaagtgtttgggccttccagattttcctctatgggatgcgaatgacttggaattttgggaattccaactccccatctctaattttatttaaattgctttctcaattgactgacgaagattagttggaccccatttctgaacaagcttgttacacagaaatgttgccagggcctactgtttatcctcttgagccaagaagagaatccttcagacttctaagttactgaacacatgcagtatcagaactattggatacacagaaagttttgttgtagataatatatttggaaagtttggagaaagttcctctaccccttgccttctttgag

SEQ ID NO: 70237 - DNA, 448 bp, Homo sapiens
gggacggtgagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctccacccaagcg

SEQ ID NO: 70238 - DNA, 626 bp, Homo sapiens
ttttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctccacccaagcg

SEQ ID NO: 70239 - DNA, 343 bp, Homo sapiens
ttgttgttataataataaatcagtagatcaccttcgatccatcactatgattggaagaacatctcagtattacctgctgttgggtaaaatagcactactgttaattctacagtaggactttttaactttctcctactcccctttgtaagagacaaacgaggtatgggtgagcaatccagatatttgaggattaaatgaaacatgttgaacatctgattttatataagatgctgtaaaaagccgaagtgaaataggtgtgctatgccatgacctccactcagcctgcttaggaggctgaaggctgggggcctattagtcctgggggaagctgtgattagacgtg

SEQ ID NO: 70240 - DNA, 531 bp, Homo sapiens
gagctggcaattgggataggttgagggggtcttgaccctgaaggggttgcttttgtggaccttttatctgggccgaggtgtgcagtgtcacaatcactgggctacaaggctgctgatagacacttctattgcagaaacagctcattatatttcttgactccagagtatttcagcagataaacaggcatgcaaggttgctttatttaaggagttaggggaccaggaaatatttgttgtcagggacaatgcaagtggtaaacattttatcccttaaaaggcaagaaagctcagaggacatgaggaaagcctgcaaaagcaggaaattggccatttaaaaagtacgcatgaggtccctactccagggagtgtttgctgagccccaggggagaaaggaagaggatgggccagccaggagtgcccagtggatttacagcagatttaataagtctactttaattatttaaatgaatcaaaatgcataggagtggaagaaagaaacaagtaaaaagaaataaaaattcttttcggaaa

SEQ ID NO: 70241 - DNA, 293 bp, Homo sapiens
tataatggcacctactgttgaggtatagtattgtagcttaatattaattataatataaaatatctagaaaaaataagtcaagatactgtttttctgggggtaggcatgtttagtttgaaattttccataggaagaaagtcctctgaaaacgtattgccaataagtgcattgcaggacatgatatataaagaaaatattggacagtatatatatggagaattttagaatttagaatatgacatgaaatgaaggtgagatttcacttggttagaattttcttgaccagtctctca

SEQ ID NO: 70242 - DNA, 1220 bp, Homo sapiens
ctctcggttcggtgtggccagccagcccagagagccatggagctaatgacctcagagcaaaacaggcgcttgggagccgctgggtatgaggcgccaggtgtgacaccacctctggatggggctgctggagcgagagcgggcaagctggtaccgggtggggttgcgggattaatgacgcaggctgcagccgaccaccccggaatcaggagccggggtagattcctgggctcctgatgcgctgttccccgtgaagaccacctctagatctgggagagcggttgctactcccaccctcctttctctctcagaacccaggtctttcccacaatgtagaccttccctgaccacagcaggacaagctattaataggataataacaacataacaaatactatttattgaagaagtactgcatactagaccctttacaaagcacgttccatacagtattaggttatttatactgcacaccaatccttcaagatggttttttttctgtcagtttcacggatgaggcaggacgggacgcttcctgtcattttaccgtgacttgccccaggaggtcacacggtcaagtgaaagattcacacctatgtcggcctcctgacattcaaacctgctctgtcttaagaaccaagcttacttctccggatcagggaggaagggctagaaaggagatcaatggcagagagaggagtgggggttcctcccctcccatccttctcttagggccagggctgagagcagtccgggaatgctgagcaagttctgtgtctaccgccagggggagacagaggccaggctaagcccttgcctaagaagagtaaaagcacactcactggaagaccaggacagagcccaatgcctggttggctgcccgttcttcctaacttctcccctctgggagagggtggtactgacctgatgccacaagagctctgtctctaaacctcctatcagaaagttgatcgctaggtatccacagacaccacccatccacacatctcaaatggggacaacgccgttgtggccctcaagcaagttggaagtagccatcagggactacggcacccagttcacggctggaacttttctgggctctgtcggccaggtgcttcctgaccacataccactttgttccccaggctaaactgtgtccccagaagggatgactttcttggcagcttccaaataaagatcccacagtggtccttcaaatt

SEQ ID NO: 70243 - DNA, 296 bp, Homo sapiens
cttcccaggcaatctctataattccatgattccccatatctcatttccatggtcacaaactaataaaagccacaactacgtcatatcaaaataaacattgcctgatgactctctttacccttcaacctaccctttagataaagatattcccccagacactatttttatgacaccaagctccttgctcaaaaatagtaaatgcataattaaccaactttgctgaagtacaagaatcttcaggggcacttgttacgaaaggattctaggaccctggccccagtctccaaggaagggat

SEQ ID NO: 70244 - DNA, 341 bp, Homo sapiens
gtcattatacaaaaatgacatgtactttttatattgaattgttcacagttttgttcttctttgaacactattcttcctagatacctaaacttcatgagccatttcaattttctgggcaatcattggcatggtctaactttcaactttatgtacctgtattagttttctatgctgctgtaacaaattgtcacaaattaagtggcttaaaacaatccacataccatgggctaaaatcaaggggccaggagggctgctttcctttctggaagttctagggcagaatctgtttccttgccttttcagcttctaaagggctgcctgcattccttggctcatgcccc

SEQ ID NO: 70245 - DNA, 329 bp, Homo sapiens
tggtttctagtttcagttgacgtacgagcctgctgccagctggcctcacatctttcatgtgactctcacaaccggagacccggacattggagaaaccctcagtaagagagatccaactgggttcagaccccgaggctgtgttgacgggacatgaggcaggatatagaccaggagccacctcctgaaatttagagcaaaactacaaaacaaggcctttgggagaccagggtgggagcatcacttgagcccaggaatttgaggcaacagtgagccatgatctcaccactgtattccatccagtctggacaagagagcgagaccctgtctca

SEQ ID NO: 70246 - DNA, 486 bp, Homo sapiens
catcatctcttgaaaaaatcatcacaatcaactgaaatgcactggtattatataagtgactcagctctgttccgtaagaaaaccacgcttttcttatcgaccttgagtagcagacagtgatataagagcatattaaaatcctctttaaggtcaagccaaattccacagcttgctatctatcattttagtttgcttttccaatgttcattggccttgagagttgtaaatacacaagtctgtcctcgattcacttttctcttttactctagtgagtatttcctgttgttttccttttgacttgattttaaaatgaccatttcaggggattcatctagatttctatgtgagaaaaaaaattcaggaacttggcatctctggctgggtttgatgagtagcagataggtagctctctagttaagtaacgtggggagcagaggttataggtctttgtagattagaaaacgttaaatgcattaacttggtggt

SEQ ID NO: 70247 - DNA, 495 bp, Homo sapiens
gtaactagcagatattttttaatctgaggacttctttctagtaaatagagatttcttcccaagcattataggaatatgtcttattgacttatttttttggcatgggttactaggaaataatattttcagggagttcagggacccagatttgattcccagataattcagattaaccttctttaatcattctattttatgttattgctgggattacaggcgtgagctaccgcacccggccagtagtttttaatgttcagtgaagttaaaacatctcccgtccagttatgctgtgtaataaatattaaagcaggagatattagaacaatacaacacttactgtgctatttataatttaaaatattaaagataaataatggaataactataaatattgatactatgataaaacttttagcatgtctaagttgttcattttgatagatacaaaaaaccaaagccaagcaaaataaaacacacctaaaactttatgaatgt

SEQ ID NO: 70248 - DNA, 492 bp, Homo sapiens
tctgcctactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctct

SEQ ID NO: 70249 - DNA, 1171 bp, Homo sapiens
taatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgagggacctcccaggtgtggctgccacagaagagacgggt

SEQ ID NO: 70250 - DNA, 1514 bp, Homo sapiens
taatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctgggcccaggctgtcctgggtggagacacttggagtcctgatgttggttggcctggcccagggttgttcctggtggaagacactg

SEQ ID NO: 70251 - DNA, 4714 bp, Homo sapiens
  misc_feature (1925)..(1925): n is a, c, g, or t
gtcaccaatccttcccctctgtcatttagcgaaccactcactgggcactaggactttggggagagtcccaagaggcccctcttcgtccaggggctacttttttctcttccagcctccatctcctaactcaaggggtacagctcagattatgtttggcgcccagggacagtgacaaacccagggcccgtggatagaggaggcatctcactacgctgcacgaggccacctcgcagtaggcagcccagccctgccccaaaacccaagagcctaaccaggaagacagggggaggccgcgggcttcatctcccaagagatggactacacctcccagcaggctctgcgcgcgggctgaggatccctccgctctttttctgtcccgccggctgggccccccgcgaccagccaagggccaaggacaggtctttcagaatctgaggtacatcttcttatcacatttccggggagggactgctaggagctccggaggaaaaacggactttttttgaggagaaaagcggaggcagacggtggatgacaacacgtcccgcagctgcagattttcgcgcgctttggcgcaggtggttgtgggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtngaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaagtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctctaatcccaggactttgggaggccaaggcgggcagatcaccggagtcaggagttcgagaccagcctgaccaacatggagaaaccccatctctactaaaaatacaaaattagccgggtggtgtggcgcatgcctataatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctgggccagagggttattataccatcctgtctctgggcccactgtgggtaattccacatccagggtaccaccgccatttcaggagttgtctcaccccttcttcgtggcctttt

SEQ ID NO: 70252 - DNA, 650 bp, Homo sapiens
gctttaatctatatcctcctgccatagcagtgaactagtgctatagaacagaaattttatttaatttagtatatcaacagcctatgttttttaatcttggtcttggtaagacataaaaatttgagaaatgatttacttggtgttttgcatcaatgtgttaccttctattttaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaatgtataaattgggagaagaggctgggcatggtggctcacacgtataatcctagcactttcggaggtcaaggtgagcagatagcttgagcccaggatttcgagaccagcttgggcaacatggtgaaacctcatctctataaaaagtataaaaatcagctgggcattgtggcttgcacctataggcccagctacttgggagactgaggtgggaggatctcttgagcccaggaggcaaggctgcagtgagccgagatcatgacactgtacctcagcctgggcaatagagcaagaccctg

SEQ ID NO: 70253 - DNA, 1692 bp, Homo sapiens
ccacaggccaaaagcctgaactttaaaggtagaaaaaatcataaatgttagtggtttttagtcatggactggcctggggttaatggttttctgcaaggttgctctcagtgccaacttataattgaagttttgttcagagccatttttctttcaaaaagcagttgataaatgcggtttttattttccttaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaagtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctctaatcccaggactttgggaggccaaggcgggcagatcaccggagtcaggagttcgagaccagcctgaccaacatggagaaaccccatctctactaaaaatacaaaattagccgggtggtgtggcgcatgcctataatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctgggccagagggttattataccatcctgtctctgggcccactgtgggtaattccacatccagggtaccaccgccatttcaggagttgtctcaccccttcttcgtggcctttt

SEQ ID NO: 70254 - DNA, 418 bp, Homo sapiens
cccacaggccaaaagcctgaactttaaaggtagaaaaaatcataaatgttagtggtttttagtcatggactggcctggggttaatggttttctgcaaggttgctctcagtgccaacttataattgaagttttgttcagagccatttttctttcaaaaagcagttgataaatgcggtttttattttccttaggtaacaaaagaagaaagaacttttcaagaaattatgaaaagttataggaatcagccccaagctaatagtcacgtgagttacattatttttcctactgtccaaaaatagatttactcttttccactgacaagttatataaaaggtaaacttattttatagttttaatatacttcagattttctgttttaatggataacattaaactcaagagataatttcattgaagg

SEQ ID NO: 70255 - DNA, 3672 bp, Homo sapiens
  misc_feature (1925)..(1925): n is a, c, g, or t
gtcaccaatccttcccctctgtcatttagcgaaccactcactgggcactaggactttggggagagtcccaagaggcccctcttcgtccaggggctacttttttctcttccagcctccatctcctaactcaaggggtacagctcagattatgtttggcgcccagggacagtgacaaacccagggcccgtggatagaggaggcatctcactacgctgcacgaggccacctcgcagtaggcagcccagccctgccccaaaacccaagagcctaaccaggaagacagggggaggccgcgggcttcatctcccaagagatggactacacctcccagcaggctctgcgcgcgggctgaggatccctccgctctttttctgtcccgccggctgggccccccgcgaccagccaagggccaaggacaggtctttcagaatctgaggtacatcttcttatcacatttccggggagggactgctaggagctccggaggaaaaacggactttttttgaggagaaaagcggaggcagacggtggatgacaacacgtcccgcagctgcagattttcgcgcgctttggcgcaggtggttgtgggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtngaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtggtaagttatccaatttaacatattatatgtaaaacacattggatcacactgtacataatacagtgggtgtcagacaacatggaaatgtgaatcataaggaggtgaggtggacaatgcatatgttttgaaaacaaataagtttgagattagaatgtgctggtatagtttattgaaaccattaatttgtcccctgttaattgtgttttggaagaagttttctagtctacttatacatgttaatgaaacacgtaaaagagacttaataaaattctaaaatctgaatgacagggaaaacaa

SEQ ID NO: 70256 - DNA, 327 bp, Homo sapiens
tggcccctcgaggcccaagaattcggcacagggcttatggagcatcacagtggtagtcagggtcctttactgaccactggggacttagggaaagaaaagaaagaaaagaaagagaagaagctggggtctccaggcagggtagtaagctgacactaaataatttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcaga

SEQ ID NO: 70257 - DNA, 4530 bp, Homo sapiens
gaattccccagacttgtaagccgggggctgagcctcagggcaggggtgcagatgggggtgcagcctccccgcttcccggcgactccgggaaggtcagcgcgggcagtcggggcgcgctcctgcggccgggcctcgccggcaacccggtccccacctgaaaccccgcctgccactccgttccagagggccaatagccgtgcaacctgcccgggatggggcgggacttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggagctggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcaccttgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccacaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaataatttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcaga

SEQ ID NO: 70258 - DNA, 4858 bp, Homo sapiens
gaattccccagacttgtaagccgggggctgagcctcagggcaggggtgcagatgggggtgcagcctccccgcttcccggcgactccgggaaggtcagcgcgggcagtcggggcgcgctcctgcggccgggcctcgccggcaacccggtccccacctgaaaccccgcctgccactccgttccagagggccaatagccgtgcaacctgcccgggatggggcgggacttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggagctggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcaccttgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccacaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaataatttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaaggggggggtctgggtagcaggggaaggaggccagttccagtgtagccccctatcccctccagatgtgctgcttctggctgtgcaatgactcggtcccctgcgaggtgggccctggcatccggggggccgtgtcgcgccgacatagtacgcgagccgggcccttcc

SEQ ID NO: 70259 - DNA, 2929 bp, Homo sapiens
gaattccccagacttgtaagccgggggctgagcctcagggcaggggtgcagatgggggtgcagcctccccgcttcccggcgactccgggaaggtcagcgcgggcagtcggggcgcgctcctgcggccgggcctcgccggcaacccggtccccacctgaaaccccgcctgccactccgttccagagggccaatagccgtgcaacctgcccgggatggggcgggacttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgactgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaaggggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtgaaaaaagc

SEQ ID NO: 70260 - DNA, 4869 bp, Homo sapiens
gaattccccagacttgtaagccgggggctgagcctcagggcaggggtgcagatgggggtgcagcctccccgcttcccggcgactccgggaaggtcagcgcgggcagtcggggcgcgctcctgcggccgggcctcgccggcaacccggtccccacctgaaaccccgcctgccactccgttccagagggccaatagccgtgcaacctgcccgggatggggcgggacttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggagctggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcaccttgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccacaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaataatttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaaggggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtgaaaaaagc

SEQ ID NO: 70261 - DNA, 3819 bp, Homo sapiens
gaattccccagacttgtaagccgggggctgagcctcagggcaggggtgcagatgggggtgcagcctccccgcttcccggcgactccgggaaggtcagcgcgggcagtcggggcgcgctcctgcggccgggcctcgccggcaacccggtccccacctgaaaccccgcctgccactccgttccagagggccaatagccgtgcaacctgcccgggatggggcgggacttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggagctggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttatagtgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaaggggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtgaaaaaagc

SEQ ID NO: 70262 - DNA, 366 bp, Homo sapiens
aattaaaggaaataatcaatgtgaaggacttagtgataggttggttattgtacaataactcattagatgctcacggttctgtgagacaagtattactatttcatgtatgaagaatctgaggctaaaaaaattaatttgcccaaagtttcttacctagtaagtggctgactcagtatgccatcccaggtcctctgttagtgtaggaattgccctggcctagaccaaccagctgttaaaggataacagagcaaatatttatactgatagtacatatgttttggtggttcgtcaatgactttggagtgctttaaaaacaaagatttcctgaccgcttcaggaacctctacgaaatgaatggcaaattaa

SEQ ID NO: 70263 - DNA, 1610 bp, Homo sapiens
aagaaattgagaaaagggtaggaaagcagatgtgaatggcaaaactggtggggagaggcaccccaggccatgggctggagcagagggcctggcaggggtggtgggagaggcagcagggggaagagcagtcagcaaagtggctacagaggtcagcagggagctcctgaggaccaagggtggcctgggaaggtctggggactagatcctgagggcagtggggtggtcactgtaggatttcaagggagtcagatttgtgttctagaaaggttgtcaccatatggcctgaccatatgccagtctggttcattactgttttcctagcacctagctcagtgccagcacacagtagatgttcagtaaatgctttgaatcaatacacagatgccagcggtgtatccagaggcaatggttaactcctgtgggggtccttcagcttcagtttcctcctttgtgaacgagggcactggcacctgcctggtgggcatgttgtgatggtgaagggagcatggcagtttgggcttgctgtcctgcacacggtcagcgctctgtaatggcagcttttataaaacgtgtggaggatgtgccaaggggaacatgggggcaaggaccctggacaggagtggtcaagtcagccagaggagagagaataatgatgacaacagtgacgttgatcaaaggctgaagttcttcatgtatttcattcatgtcatcctcaacacagtgaaggaagacggcaccgtagttatccctgtgttattttccaggaggcggcggctcagagaggagtgactcgcctgaagccccgtgaacaatgcatggtggacggaagtacatggaatgccagagccaggctggtgactagtgctggtggtggggactggtcaaggcggccgccagggaagggatgtgaggacacggtctagactgatggaccagatggcgggggcaggcacagggggagggaggtttccaggacacccctcagtttctggcccaggtgaccaggtggaaggtcattccatctcctgagtgagggacacagcaggacagacaggcttggggagggactgttgggatgtctggagtctaggagaggatccaggcgggggatggaggggagggcggaatgagctcatggggcaagtggaaggcttgtgggcggtggaaaagctccagcccccggacacctagccaaggtcaagtaataacgacagtagacgttacatagccttgactctgtacagacctcatcctgcatccttacgttaactcattgaaccctcccaaccattatcaaattggaggtaccattatcacccccattttatagttggggaaactgaggcaagagacattaagtctgcaatattggaataggcaaatctgtagagaaaggaatgtgggtgagtggtgggctggggctgggggctgggaaggatcatggctaacgggcacaggctttcttttttgggtgatgaaaatattctaaaatgactgtgaaaatattgcacaactctgtgaacatgtgaaaacccactgaactgtatgctctaactgtatgaattgtatggtatttgaatttcacctcaataaagctgttatcaaaaagc

SEQ ID NO: 70264 - DNA, 572 bp, Homo sapiens
ctttattttaggagatgtaaacagaagattcagaggtgacatgtcatcatgtttgcaacttatttacaaatagttcagtgctcagtacgtgtgtgtgtgtgtgtgtgtgtgtattttgagtggcatcagttgcattcttttcttcctctgcctgtctggagggcacttttaatgtacctgtcctcatactctccattatgagttttaatcacaatagaaatttttttcccaccactttgatgaaaggtcatatttattgggcagacttatctattctatttaataatcttataatatactatatacattacctggggtaaatgtaagtacagcatttaggatttcacaatctatttacaaatgagactgacctgtaaatcccccttttggggaatactactatggtcagattctggttattttaagtgaataaaatgaaccggatggcttcgcatgctctgacaccatttatataagaatcatctgttcaataacacgtaggacgaggactctgctactgaaacttcctgagtgaacactgataagtggcatgaagaaacaaccaaagcaac

SEQ ID NO: 70265 - DNA, 491 bp, Homo sapiens
ctttattttaggagatgtaaacagaagattcagaggtgacatgtcatcatgtttgcaacttatttacaaatagttcagtgctcagtacgtgtgtgtgtgtgtgtgtgtgtgtgtgtgtgtgtgtgtgtggtgtgtgtgtgatgtaaaatacatactctacagtgaaatgttaacaacgttgaatttagatggtgggtatactgacgttcattttatcattatttcaccttttccttatgtttcaacattttcacagttaaaagttggaggcataaactctccagatgactccgatgttctcccaggtttaggtgctgtgtggtagacttcactgagctctaagagggaaggtgtgtctgtcttttgagtcctacagcacaagtctagcagatggtaaattcttgtcaacctgggctcccttctctcctctcctctggatttttgggacacttagcaaatcatttctgacttactcatgaggcttgtctctt

SEQ ID NO: 70266 - DNA, 316 bp, Homo sapiens
tgctaacctttcagttcaattgcattgtgatctttattcagtttgaccagcaagaaaatttcagtagagcattttaatagggagaaagctgaattttaaattagattactagtttggaatgagacttacgattgttgctaggagtagaggataataataagaacaaatatttataaagaacagcttatgaagcattttaacataccttaataattctcacagcaagcatatgagttagctattactcctgtttgcatttgacagataacactgaggctagaaaaggttaaattactagatgtccatggtcacacag

SEQ ID NO: 70267 - DNA, 371 bp, Homo sapiens
ctactcaggaggctgaggggagaggatcacttgagccctggaggtagaggctgcagtgagctgtcatcgtgtcagtgcactcctgcctgggggacagggagaaaccccgtctcaaaaaaataaactggataaacacttaagtgtttgaaatactttcacgaatactttcacaggaacagatgaatagaaatcacttagcaacattttcaaggcaacatctgaaaactactttgtctatttcctgacgtatgttagggcctaagtgaaccaaaagagatgtctacaatgccagttctgaaaatgttaccactttggtcagacaagtgtttagtcttactgtatagttctgtttatcagaaacccagagtagc

SEQ ID NO: 70268 - DNA, 581 bp, Homo sapiens
  misc_feature (575)..(575): n is a, c, g, or t
  misc_feature (577)..(578): n is a, c, g, or t
ctggctggtgcccgggcagagtcgcagggaagagaggccaagagccaacgctgacctcactgtgcgggtgcactgggggcccctgcgaagctgacctcactgcgcaggtgcactgggggcctccgtgaaggggtcggtgaggagctggacaaagatcagagcaggtttgagagagaatgggaaggcagaacctggagcttgcagatgaagcagtggagagggatgtggatcgatgttttggtttttttaatggagcagattacagtttacagattgctgagagaatggtccaacagaaagtgaggaggaggaatgagtctaatgtctgtacgaagcaactagagtcttgttaaaatgcagattccttcaaacctagggatcctgaaaaaaaggaaaatgcagattctcagagggagagagtccaggggtgcgggggccagtcaaaaaaactacctactggataccatgctaagtgatgcgatccttactgcagacctcagcatcacgcgatatacccaggtaacaaacctgcacatgtaccccctgtatttaaaataaaagttgaaattagaaanannaaa

SEQ ID NO: 70269 - DNA, 469 bp, Homo sapiens
tatggtattaaaatcttgctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcatgaacaaaatgcccatgttggtcctctgccctggacctgtgacattctggactatttctgtgtttatttgtggccgagtgtaacaaccatataataaatcacctcttccgcggttttagctgaagaattaaaaaaaataaaataaaataaaatcttatgg

SEQ ID NO: 70270 - DNA, 269 bp, Homo sapiens
actgtacactttacaaacactgtacacttggccatactaaatttattttaaaaacatacattcaataatagattaacctaacttactgtaactttcttacattttataaacttttttttttaacttcttgactcttgtagtaacacttagcttaaaacacaaacacagtacagctatacaaaaatatctttcttttatcttttttccgagatggagtctccctctgtcacccaggctggaatgcagtggcacgatcttagctcactgca

SEQ ID NO: 70271 - DNA, 446 bp, Homo sapiens
agtatcagattgtttgctccataaaaactgttctggtttatagctgtatcccaggagtccaggccagttgtcagcacataataggggctcaataaatatttgctaaaaaaaaaaaaagaatcaagctgttaaaaattaagcttatctttcttgaaaaattccaatgtagattagatatgtatgatgaatgcctcccaagtcttcagtaaattttctcatgaacagtttccacagcagcacagagccattatttaggtggttgtaaaaatatgaatttgattgttaccaagtagggtagtcttgtttaaaatacaaaagataaagttgtaaaagtgggcaattatgatgggattcaccagtaatgcttctcttcttccaattatcaggaagattcacccatctagaacaaaggctcttaacacatattagagtcaccaggagagctc

SEQ ID NO: 70272 - DNA, 165 bp, Homo sapiens
ataaaatattttaaaagagaaactgagtcaatatttatggcaatacttggttggcatagctagaattcaacaaatattcatcattactaaagtgtgttttgatagtgctgagatgttttctttttcttctgtatcttcatggatatctagaagaacacagaaatt

SEQ ID NO: 70273 - DNA, 892 bp, Homo sapiens
agacaagtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccgcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgggccaaaggtc

SEQ ID NO: 70274 - DNA, 739 bp, Homo sapiens
  misc_feature (49)..(49): n is a, c, g, or t
attaaactcatattttcatacgaaataatgaggagaagtagcagcatgnctctcttattatccaccgctacagaaaataggaggtcaagaggaggagaaggggcagagtttcaggtgtcccagatttgcagtgacacgaagcagagaattaggatgggaagaagtgtcatggcttaccagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccgcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgggccaaaggtc

SEQ ID NO: 70275 - DNA, 873 bp, Homo sapiens
agacaagtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccgcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgggccaaaggtc

SEQ ID NO: 70276 - DNA, 310 bp, Homo sapiens
aatctaggtctccaggcctcagatgcagctatctctgtcagcatcagacagcctccttgattctggcaagagagtgaatggctggttgttgcctggcaaccacagccaccccagatgttttctatctccacattttcatgagaatcaggccattcagcgatagctgggctcagacctcagagagaaaatgtctctggtcttaggggcagtagggacaggactcctcatgtttgaagcatttacctaggctaggcacagtcagttcccctccaggttctagaactctcccaggctgccccgacccatttct

SEQ ID NO: 70277 - DNA, 285 bp, Homo sapiens
gtgtgtgtgtgtgtgagagagagagagagagagagaaattcattgatgactgtatttttaatcctccttccttggtacactatttattcattttacatgaacctcaaagcagaggcacagagctggtattgaatgccagatccttgatcacactatctatcttactgaaaatgtaagagctaaggggttcattgatgctagtttgttttgtagctagagtatccttacctgacttgtgaccttgggcatgtaccttcatctttttgtgccttcacctttctcacc

SEQ ID NO: 70278 - DNA, 662 bp, Homo sapiens
gatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccggcactttgggaggccgaggcaggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaagtcgacgcggccgcgaatttagtagtagta

SEQ ID NO: 70279 - DNA, 174 bp, Homo sapiens
gcttctcttaaaacataggaaggtgcggcgggcagctctgagtgccagcccggtggcagattttccagagtagtggtgtcttgcccaggtatccgtttcattcttcaggttcattgagtcttacagatacaagttttgaatccattgctcaggagcgtttagtgcagatggtct

SEQ ID NO: 70280 - DNA, 443 bp, Homo sapiens
  misc_feature (434)..(434): n is a, c, g, or t
  misc_feature (443)..(443): n is a, c, g, or t
ttagcagaaattctttttgatactaacttgtgtgtaatgtatttcaggactatgactatgattttggggggaatttttttaaaatgtcaaaccagtgaactccaggagtagaggggagtcctaattttttctttatctgtttagaaaccaccggggtgatgagcatgctttttaacagcaaaagcttctctagatgtagaaataattttttttcttttgggtctaatttatattgacaaataatttgaggctaggagttctaggtctagactccctcccagggccattgtgagatttaaatgagatttaatgaatttgaaaacacattgtaagttttaaataacttcacagctataaggggttgctaatactatcagtgtctgagatatctagaataccaaggaattttcttctaatttgttagcaagattttnttcccctcn

SEQ ID NO: 70281 - DNA, 223 bp, Homo sapiens
ctgtcagtaatggctcactaaagggccagcagtttaaattacacaggttgcactaaaagctgcagctttggccaggcaaggtggatcacgcctataatcccaacactttgggaggccgaggcgggcaaatcacctgaggtcaggagttcaagaccagcctggccaatatggtgaaacctagcctctactaaaaatacaaaaattagccggacgtggtggcaca

SEQ ID NO: 70282 - DNA, 3014 bp, Homo sapiens
  misc_feature (531)..(531): n is a, c, g, or t
  misc_feature (538)..(538): n is a, c, g, or t
  misc_feature (563)..(563): n is a, c, g, or t
  misc_feature (1002)..(1002): n is a, c, g, or t
  misc_feature (1129)..(1129): n is a, c, g, or t
  misc_feature (1389)..(1389): n is a, c, g, or t
  misc_feature (1391)..(1391): n is a, c, g, or t
  misc_feature (1752)..(1752): n is a, c, g, or t
  misc_feature (1802)..(1802): n is a, c, g, or t
atttgtaatatattttgaaatcaggaagtgcaatgtctacagcattgttttccattctcaggattgttttgggtatttgaaatcctttgtacttccatatgaattttaggatatttttctatttctgttaaaaaatgccattgtgattttgataggaatttcactgaatttgtaaactgctttgggtagtataaacattttaacaatattaagtcttctaatccatgaacacaggatatctatttatttgtgtcgtctttaattttactcatgaattttttttgcaatctacagtgtgcaagttgttcaccttctcagttaagtttatttctaagtactttgttcttttgatgatattgtaagtggggtcattttcttaatttcttttcattgtttgtacatagaaacacaaccaatttttgtatgcttgttttataccctgcaacattactgaatttgtttattataataggtttttacggtagaatctttagggtgttctacatttaagatcataccatctcaaatagntataatnttacttctttctttatgacttatanattccttttatttatttttctgcttaattagtcaggctaggacttctagtactatgttgaataggatagacaagtgtgggcatcatttccttgttcctgatgttggaggaaaagctttcgattttttttattattgaatgtgatgttagttggggtctttttatgtattttctttcttatcttaagtaaattcttctactcctagtttgttgagtttttgtcatgaaaatgtgttgaatgttttcaaatcctgggtttttaaaatctaattagactatcatgttgtttttatcctttatgtgattactgtggtctatcatgttaattttcatacgttgaaccccccttgcatccagggataaaggctacttggtggtgatgaatgatgaaaggctactatgctgttgaatttagcttgctggtgttttattgaagattntttttatctagcatagaggcagacatattgactaatggaacagaataaaaactctagaaataaatccatgcatatataaaccactgatgttttactatggtaccaggaatatacaatggaggaaggntagcctcttcaacaaatgatgttgggaaaactgggtatccacatacaaaagaatgaaatcaagtacttatcttataccatacacaaaaatcaagttaaactaggttaaagacgtaaacataagacctgaaactgtagaatgcctagaggaaaacataggaaaaatgcttcatgagttttgtcttgtcagcttcttagatatgacccccaaatcacaggcaacaaaagcaaaattagacaagtggaactagataaaactananggcttctgcatatcaaaggaaacaactaacagtaaaaagacaacctacagaatgtgagggagaaaatatttgaaaactgcatatatacgatatggagttaatatccaaaatatataaggagctcctaaatttcaatagtgaaaataatcaaataacgcaattaaaaatgggcaaaggatttgaaaaggcatttctcaaaacagacatacaaattgtcaataagtacgtaagaaagttctcaacatcactagttatcagggagatggaaatcaaaaccactatgagatatcatctcacacctgttaggaagctattatgaaaaaagtaaaaacaaatgttaataaggatatggagaaactgnaacccttgtactttgttgctgtggatataaaaggttgcagccactatagnaagcagcatggagattccgcaaaaattaaaaatagaagtactatatgatccaacaattcaacttctgggtatttatccaaaagaattgacatcaggatcttgaaaagatatttacacttccatgttctctgcagcattatacggaataaccaaaatgtggaaacaacctaaatgtccatcaatggataaagggataaagaaaatactctgtgtgtgtgtgtgtgtgtgtgtgtgtgtgtgtgtgtgtgtgtgtgtgtatgtgtgtatatgtgtgtgtgtgtatatacatatgaatatttagcttttagaaagaagaaaattctttcatatgtgatcactattatgagttttgcctccagcagcaactctgccaggtcctcacaatgaatttcagaaaagatttccttgtgcttctggcccagaaggggaaaggaaacaacttttaaatatgtcaaagtattctgttcttcttaaccaggtctgccttcaggagaaactgtaaccaaaataatcaactgagattttaacagagcctaactgatttgggagaagaggaatatccaactcgaacctactctagctatcttgttctatataggacttttctttttggaatttccactatatgtatgtttcaccttttgtagttgtctcacagttcttggatatcctattttgttgtacttttgcagtactctcacccatctatcagaaatgtacaaatcaagcaggcagaaaattagtaaggatctagttgaactcaacactattaagtaacttgatataatggacatctgtagactatttgattcagcaacaggagaatacacattcttctcaaactcctgtggaacattcaccaagatagagcatattctgagtgacataaaaatcttaaccaatttaaaataatagaaatcatataatgtctgctctcagaccacaatggatttaaactagaaattgataacagaaaaacagttggaaagttccaaaatatttagagattagatagcatacttctaagtaatataagagtcaaacaagaaatctcaagaaaaaatttaaaaatattttgaactaacagaaaatgaaaaatataacttatcaaaatgtgtaagatgcggtgatgagagagaaatttataccacttaatgcatatattagaatggaagaatgctctaaaataaatcatctaagcttccaccttag

SEQ ID NO: 70283 - DNA, 193 bp, Homo sapiens
ctcttctgtgggtgctatgtcagttcgtggagaatcatgatatgcggtacagagaggcagggttctcagtcgagttcataggctacacttacccccagtgtatgcagccaggggaagttgtgtgcgttcacaaaatgaggttcttcttgttaaggaaggggatgaatagttcccagatatgagcctcagtcta

SEQ ID NO: 70284 - DNA, 285 bp, Homo sapiens
ttttctccttacttagagcttggattgtctctttctttgcaatctcatgctgcctttctgcatcaatctattcagggtgtctctttggataaaacaatattttgaagtcatcaccttgtcaggtaacccaagaccatgcttttgtctaatgttagaaatttcttactattggaagtagtacattagactccgtgttcactggttctcttttccccatagcttgtgtttggaaacagctagaattaagtgaattaactcactgttaccagaacatggggttgttgt

SEQ ID NO: 70285 - DNA, 662 bp, Homo sapiens
tttatttatttattttttgagactaggtcttgctctgtcacccaggctagagtgcaatggtgagattatagctcactgcaatctccagctcctgggctcatgtgatccacccaccttagcctccccaagtagctgggtttattctaacaagtgtgtgccaccatacccagctatttttttttttctagatatcgggtctcactatgttgcacaggctggtctcaaactcctgggctcaagtgatcctcccacctcagccttccaaagtgcagggattacaggcatgagccactgtgctcagccccatccactcctgccagtgcagctggaggaatctattcaaaccagaaatctgagcacatcactcatttgttttagctctctgtggataaaagccaaatccctaatacattctggaaggtttctagttaaactgcacatctactatctgcctggctctgcccacattctgcttcccctcctgctaccatagatgagctcccggccctttgctgaggccgatgcctccatccctgctctgttccacccccctccttcctgaggacctagttcctttctcatttttctctctctcttgcccaatcaacacacactccatgctacattactttcctgagtgtctcgcccaagtctatcaaatc

SEQ ID NO: 70286 - DNA, 573 bp, Homo sapiens
gttccctagcctgcgccagtggcaactcaccagcaaagtggtaaacagatactagtccagaatttctaacactccataagtatctgttcacttgagagttggctggacatagttcattgggcatgcagcgaaagcacattttatttaactttaaaaattttttaatttgactacatctaataaaattaaaaattttaatctttaaattggtctttgtaaacttctgaaaaaattttaatatttttgtctgatattctgaattagtgaatgtgatgttacattttagtagaaagtagtaaaacgatgaaaacaaaaattagatcatactaagttttgcgagtttttaaacattaaatccttagacttgaatttgacttaataaaagtattgttaactattttataaatggaagtttttttctgagaatttttttttcatttaaaattttttatttggccagacacggtggctcatgcctgtaatcccagcactttgggaggctgaggtgggaggactgcttgagtccaggagtttgagaccagcctgagcaatatagtgagaccgcgtctctac

SEQ ID NO: 70287 - DNA, 325 bp, Homo sapiens
ctacaaaatgcctctgtagaaataacatttagaaacaaggcacatgaacaccacacacacacacacacacacacacacacacacacacacaatgaggcaagtatgtgagccaataactttactcacttcagagtttcaactctgattatttctaacatatgtagcgctgcaattgggccttagaatagtgtagccacaggagaagccaaagacaagagagagaagtgttttttctttcttaattttatcttacattttgtattttttcagacctacaatcctaaataatttccttctgtatgttttgtcatttaaacatcattga

SEQ ID NO: 70288 - DNA, 369 bp, Homo sapiens
ccatgattcagtacttcccactgggtccctcccatgacatgtgggaattatgggagctacaattcaagatgagatttgggtggggacacacccaaactatatcatatatgttagaatgtgatgtagattttttaaatgatctaaaagaagaatcaatgatacaaagtagtatttgtgttatattgactgggaaaagcagtagcactgttataatttcctcttgaaaaagaaattcacatgtaaatgtatatataactggaaaagtaagcacaaaaatgttaaaagtgattcttttttcagattgaaattttttttcctttttgtaaatctttttttgccctaaaattaatatatattaattttaaaagg

SEQ ID NO: 70289 - DNA, 530 bp, Homo sapiens
tacatttttaattttgggtgctaaataaatgttggatcagttatactgaataaattttccatcaacgtgttcttgctgtgggacatccttgacactaatttaagttttccaacaaatgcgactttccaatattttaagcatgacagaattttgctagacagctggctgtctttctcctgttcctctggatgccactcaaatatcttcacacccatctcactcattaacactgcgtgaactgtgagctctccaccccttgtctgtctgtaatctgggttgtgactacttgtttatccagtttatcttctttctcatcatccatcctggtttctgcatactataacaacatcggttgcatactattgacctctaaccctggatcctgttgggatgaaaacattatcccagtcctgttgaaagtagtgcagtggccttttcttctttcttggttctgcaatgtctgcagagatgtgctcttggggggatgaagtcatctgggtagctttcccctccctgtgcccaggttgcta

SEQ ID NO: 70290 - DNA, 176 bp, Homo sapiens
  misc_feature (46)..(46): n is a, c, g, or t
gaatagataagacaacagcctaccttcaagtgatagtacaccaccncacaaacagaatatgacccttataacagtacacttccacttagcccctcctggactttgtgctattgttgtcagatattttactggtttttttgttttgttttgttttgtttgtttgttttgttttgttt

SEQ ID NO: 70291 - DNA, 821 bp, Homo sapiens
gtcatatgccagtgagcactagattaagtatatccttggtggttccgggtgagtctatctggctgctttggcttcaggaacatgggaacgatgcctgtggaggtgggcgtacaccgtctggagggaagatggggtgatagggtgtgtgcgtgtttgtcttcttgcctgtagttctcaaaaagaggcatggtggtcatttttaaaatctatgcttttttcttattcaagttatttggtactttacccatataagggtatttctggaatgatattgtttcatcctttcatttcttctttgggcatggtgattcccacacctgcaactctatttatgtcctcctttcttttcccagctctacctattagctgacttcctagtggtaccagaggcatgatttcactttgggtctgggagtttgggggaaaatgaaaaataggtttaggtattttctgggataagtggaaatcctgtctgtgtcatggagggatggccatacagagtaatccagtagtcattaaagacatacagaatcaggccgggcacagtggcttatgcctgtaatcccagcactttgggaggtcgaggtggtagtatctcttaaacccaggagttcaaaataagcctgatcaacatagcaagactctgtctttacaaaagaaaaataaaaaatcagctgggtgtggtggtgctcttctgtagtcccacctactgggaaggctgaggcaggaagatcacttgagcccaggaattcaaggctgcagtgaaccatgattgtgccactgcaccccagcctaggtaacagagtgagaccctgtctcaa

SEQ ID NO: 70292 - DNA, 397 bp, Homo sapiens
  misc_feature (29)..(29): n is a, c, g, or t
  misc_feature (42)..(42): n is a, c, g, or t
  misc_feature (51)..(51): n is a, c, g, or t
  misc_feature (53)..(53): n is a, c, g, or t
  misc_feature (61)..(61): n is a, c, g, or t
  misc_feature (74)..(74): n is a, c, g, or t
  misc_feature (78)..(79): n is a, c, g, or t
  misc_feature (81)..(81): n is a, c, g, or t
  misc_feature (89)..(89): n is a, c, g, or t
  misc_feature (91)..(92): n is a, c, g, or t
  misc_feature (96)..(97): n is a, c, g, or t
  misc_feature (105)..(106): n is a, c, g, or t
atgcgccaccactcccggctaattttgtnttttagtagaganggggtttcncnatgttggncaggctggtctcnaacnncngacctcangnnatcnncccacctnngcctcccaaagtgctgagattacaggtgtgagccaccgcactttgggaggtcgaggtggtagtatctcttaaacccaggagttcaaaataagcctgatcaacatagcaagactctgtctttacaaaagaaaaataaaaaatcagctgggtgtggtggtgctcttctgtagtcccacctactgggaaggctgaggcaggaagatcacttgagcccaggaattcaaggctgcagtgaaccatgattgtgccactgcaccccagcctaggtaacagagtgagaccctgtctcaa

SEQ ID NO: 70293 - DNA, 360 bp, Homo sapiens
  misc_feature (29)..(29): n is a, c, g, or t
  misc_feature (42)..(42): n is a, c, g, or t
  misc_feature (51)..(51): n is a, c, g, or t
  misc_feature (53)..(53): n is a, c, g, or t
  misc_feature (61)..(61): n is a, c, g, or t
  misc_feature (74)..(74): n is a, c, g, or t
  misc_feature (78)..(79): n is a, c, g, or t
  misc_feature (81)..(81): n is a, c, g, or t
  misc_feature (89)..(89): n is a, c, g, or t
  misc_feature (91)..(92): n is a, c, g, or t
  misc_feature (96)..(97): n is a, c, g, or t
  misc_feature (105)..(106): n is a, c, g, or t
atgcgccaccactcccggctaattttgtnttttagtagaganggggtttcncnatgttggncaggctggtctcnaacnncngacctcangnnatcnncccacctnngcactttgggaggtcgaggtggtagtatctcttaaacccaggagttcaaaataagcctgatcaacatagcaagactctgtctttacaaaagaaaaataaaaaatcagctgggtgtggtggtgctcttctgtagtcccacctactgggaaggctgaggcaggaagatcacttgagcccaggaattcaaggctgcagtgaaccatgattgtgccactgcaccccagcctaggtaacagagtgagaccctgtctcaa

SEQ ID NO: 70294 - DNA, 285 bp, Homo sapiens
ctgtgaccagaagaggtcatttgtaaccttgagatagtatgtggtaaagtaaaaaggactcttaagaaaaaaataacaagttcagatggttcatgaagtattatggacaaaaggtcatagtatttattcaaaaagaggaaagatgtaactactttgaaaactagaagagaaagaactaaaggagaaaagaattcttaggccaggtgcagtgactgacacctgtaatcccagcactctgggaggctgaggcatgtggatcatctgaggtcaggagttcaagaccag

SEQ ID NO: 70295 - DNA, 496 bp, Homo sapiens
aagcatgtgggtccttaagtaatcctgccttcaaattgttctcaggcattttgctaagcccagatgtcccatcttctcctgtcctgaacttttacagcctttttcttcagaagctgcaaactaattgcattccttactctgagtagagcttgctggccagggcagtggacactcgagtagtcattaagatacaagtcacccgagaggttgtaggagccctgcagttctgcaagaggacaaatatgaatgttctcattgaaaaattacattcaggcaggggtggttgcacacgcctataatcctagcactttgggaggccaaggtgggtgatcacctgaggtcatgagtttgagaccagcctggccaacatgctgaaaccccatctctactaaaaatacaaaaatttagccaggcatggtcgtgtgtgcttgtaatcccagctgctctggatgctgaggcaggagaggggaggcagagaggttgcagtgagccgaga

SEQ ID NO: 70296 - DNA, 428 bp, Homo sapiens
ataaggtagagtttatcatattgataatttgcagtttaacaaacttcaatcaacttctttatcttcggcttttctcccggaagagactgaatcactgagtgagttctcataaacttcaacttcattccttcccttgaagttgccctctctagatttttctctactaccactaattttcttttttctttttttgagatggagtctcattctgtcgtccaggctgcagtgcggtggcacaatctcagctcactgcaactccaggctgggtgacagaattggccccccccaaaaaaaagaacttttatgtaataaatgtctaaagcaaaaattgttataaataaagagaaacagaaagaagcaccaaaacttgattggtccacgagacaaacagataaagtaaaaaagccccaaacaaaaaaagaagatat

SEQ ID NO: 70297 - DNA, 498 bp, Homo sapiens
aaatttgtcaagatttgtcacatataaaatgacaaggagcagaaagtaaggtggatagggctgcagacagcagaaacagcatgttcaaaggtacaaatttatagagcacattggggaaacagaaaataattttgtgaagatccaaagggatggtatggcaaaaatacaacttcatcaaaaatggccaccggatttaagagattattgtattactcattaattattgctcataaatgtcatggactaatacattatttgagctcataaggaattgattatgtagttcaatacccagagatgtgacaactgatggaaatgaaattaaaactaagactattgcttccaaaactagcacttcacctccatgaattatgaaaataattctgttgttgagatagctagaataccaggctaactgaattttacttaaaagaaagttcccattccaaagcagtcaggttaggtgagtggtgtttaaatgtctgtgttttttgcatg

SEQ ID NO: 70298 - DNA, 1345 bp, Homo sapiens
gtagtttcttccagcccccatgcccgtgagtttagccaggcctgttacctgctaccctcttccccgccttcctccaccctgcagaggagcagagcgtagcctgagtgcctgggccagcagggtgagggagtgggccagaaccatgcagatgtcatccaggacaccctctcggccagtgtccatagcactctgacttcaccaggggagccctgcacaggagacactcagtttgttctcagaaatccagtagctgggctgacccatccatctgccctggctctcagaaaccagaatcactcaggctgagccgtgggtcctgcaggtctttcccctgtgggaggccagcatcttcgcttgctctcttctccacctgaagaccaactgtcatcttaccagcgagctcagctgccagggtttgtggctggcgccagtcgtattgtggacatgggcttatgctgagcacagaccaggtgctcctctgggaggagtgagactcacgggaacaccatcctccgctttctcgtgaggagggtgccccctccttgaacttacctaagggacgatggccagagaatagtgaaatgtatgcaggtgccactgcttagttcctgagaactgtttagctgtcatttttttgcccttaaatatgcctttttttaaagcacatttcactgatttcatgtgaatctagggtaaaaatggagtagtaagaccaggcggtgagagagtgggcttccgtccacttcagggcggaagctggttagtccacatgtcggtccttctgggaccctgccacacaggtgtccccacaccaaggctggcagaaggaggtttaaatgaccacaggcttcggatatcagaaaggcagctggaaatgacactgaggaacagatgggctataacagctgcccttgccacttggctctacatcctcctggctccgagcaggcccaccgttgcttttcctccagtagatggtgggccacgggatagagccagaacagaagactcgtcccccctccactcttgtctctggcaaatccaccagctgggaggaccacctttcctccctcctgcctctgtgcgtgtgcgtgcactccatgtcgacagccacaggtttctgctgcagcagcctcttcccctgaataggactgggattaagccccagcagctggtgcaccccactcagagcacggttaaggcagctgcccaaacctctcctcggctttctcagggcctttattcgttcaggctttctggaagtcagctggcggaggtgaagatggcttgggcgcccctcctgtgagctctgtgtgagtggtgctctttgtgatgtcaggtgagg

SEQ ID NO: 70299 - DNA, 507 bp, Homo sapiens
  misc_feature (84)..(84): n is a, c, g, or t
ggcaaaggctacaagtacaaccccatgtacagcgcctacaacaacgtcaaagcctgcctgaggaaccaccaggggccactgccnccggtgcccctgcacctgaggaacgcgcccaccgttgcttttcctccagtagatggtgggccacgggatagagccagaacagaagactcgtcccccctccactcttgtctctggcaaatccaccagctgggaggaccacctttcctccctcctgcctctgtgcgtgtgcgtgcactccatgtcgacagccacaggtttctgctgcagcagcctcttcccctgaataggactgggattaagccccagcagctggtgcaccccactcagagcacggttaaggcagctgcccaaacctctcctcggctttctcagggcctttattcgttcaggctttctggaagtcagctggcggaggtgaagatggcttgggcgcccctcctgtgagctctgtgtgagtggtgctctttgtgatgtcaggtgagg

SEQ ID NO: 70300 - DNA, 1019 bp, Homo sapiens
cctcagacctaaaaagcattgtttagagctaaaatactgcactgaaactgactaaaacacagcagaggaactcagacctggacatttttctgcttccatttacaatttcatttatcctcatgcctcacgtttgggcttagaaacctttgtctgctgaagcaggaagaccagagtatcttctgcggctgctgctgacctggccccaaccctgaagattccaactgagtggttctgatggggagagtctaagcatctgcactcccactgctatgtgacttttcagggtgtgctgctggctgggaatcaatgctgtacagagcccaccgccaggccagctgtcaggaaacaggggctctaggcccagcttcaccacttaggagctatggctttgttcagaaacattgtgactctcttacccacacattcctctgctggaaggggagattgacaaaccagcatcatctctaatttactacaaaagccctcactggaaattattcttaacttagcagctggtaggatccattaaaaaaaaaaagtaagttagactgtgttactctgctgctcaaagccctgcagtgcctcctcattttacctagcgtaaaacctagagtcctttccatggcctgctaggccctgcgccctctggcccatcatctacgaccacctctcctactgcccttcctgtcaggcctctgggcccaaacctgtacgtataaatccagatggcctgaagtaactgaagaatgacaaaagaagtgaaaatggcctgttcctgccttagctgatgacattaccttgtaaaattccttctcctggctcatcctggctcaaaagctccccaactgagcactgtgacccccacccctgccagccagagaacaaccccctttgactgtaattttccactacctaaccaaatcctataaaatggccccacccctatctcccttcgctgactcttttcggactcagcccgcctgcacccaggtgaaataaacagccttgttgctcacaca

SEQ ID NO: 70301 - DNA, 409 bp, Homo sapiens
ccttgttttactggaggagaaagtggggcacagagaaattcagttattggtccgaggtcacacagcgtgtgagtcgggaaggaaggggcagctggaatttgaacctggcagtctggcttccctctggggaagagcagtggatgagggcgaagccgacaagagcccaaactcatctgcgctgcgctgcttttgagccacacaaatccaaataagggatcatccaaatcctttattttctctcgaagttttgtgatcattaatcagttaacagcttgttcccttctgtgctggacaacccccagctgcaaggggcaggaatggagcatgggggaggctgtaaaatagatcacccaggagtttgtgagcagctgggcaacatagtgagaccctgtctctaaaagaaaaaaaa

SEQ ID NO: 70302 - DNA, 913 bp, Homo sapiens
ccttgttttactggaggagaaagtggggcacagagaaattcagttattggtccgaggtcacacagcgtgtgagtcgggaaggaaggggcagctggaatttgaacctggcagtctggcttccctctggggaagagcagtggatgagggcgaagccgacaagagcccaaactcatctgcgctgcgctgcttttgagccacacaaatccaaataagggatcatccaaatcctttattttctctcgaagttttgtgatcattaatcagttaacagcttgttcccttctgtgctggacaacccccagctgcaaggggcaggaatggagcatgggggaggctgtaaaatagatcactcaggcgtttccctagcgagccccccgggaatgaacagaagggtttctctcctatggtgggatgttgctgtccatgggggtcgtcgaaggacgggtgtggaggcccaggaggactgcaggcaagaggggagaaaaggaagaacccgtctcccctcaactggatcatcatgggctgtgttgcactggtaaaccaaggtgccaaggctgcggcagctcagatgggaaggggaccctgttttctgagcatgcagacgccaggattataggacattctgccaggcacagaaaccacgagagcccaccttccccaaaggctgctggctccaaagtggggagggagtggttgttcccaggtgataagtgatgagaagaccgttgagcccccagagtgacacccaagcatgtaactaactcgagaccaggagcatccactgacaaacgcccggtgaggtcgatcctggtgacaggatccaggtgctagtcgggtcctgagtcgagttgctggactcgcagcatttaaccattcaaaataaccagctttaaaaatgtgtgtgggccaggct

SEQ ID NO: 70303 - DNA, 376 bp, Homo sapiens
tcgagctcggtaccgacgggatactcgatcacgacctctacatcagccaggcgactgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagctaacagaatgctgcctacctgccctgaacctccaagcaagaaactgaaatgcttttctggggaactgacctgcccaagaataaagacctgaagattcgacactgggtcatccccaaggaaaaaaaccagcccattcattttacagtaaagcccagagtca

SEQ ID NO: 70304 - DNA, 4668 bp, Homo sapiens
gctttcccagaaggctccatattctcaacctgtgcaggtcaatttgacataaagctaccaacaaggagcaacaggcccactgcaggctgtgtttataacttgaaaattatgagcaggtattgggagccacagactgtatttgggaacagctgcatgtcaggacaagcatagattgtggtctgtggaggctgggagagcacaatgcttgaatttcatttctttgggagataagaagaaaaaataccttcctacctgacaagattgacaacttgctaaatctgattatcttcagaagtgtgctggacagttgcgaagtaaacatttacttttcaaagatgatgatcaaggaaacatctctacgaagggacccggatttaaggggagagctagctttcctggcaaggggctgtgattttgttctcccttcacggtttaagaagcggctgaagtcatttcagcagacacagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70305 - DNA, 3446 bp, Homo sapiens
gattgctgcaacgactctcttaacttccaccgctacagcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70306 - DNA, 2907 bp, Homo sapiens
  misc_feature (1)..(1): n is a, c, g, or t
nttaagcgtgactgactctcttattaaccaccgctcacagctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70307 - DNA, 2894 bp, Homo sapiens
cggtggcgcgacgggtgcaacgactcgctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70308 - DNA, 4628 bp, Homo sapiens
gaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70309 - DNA, 1338 bp, Homo sapiens
  misc_feature (8)..(8): n is a, c, g, or t
gtatttcnatctgaaatgaaataattgcttttcttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70310 - DNA, 402 bp, Homo sapiens
aaacatagcagactgcctgaatcctaagccagctgagggaaaaaccaagaagcaaccagatatacccagcaaaacctgcagacattcaggatttggggatactaggaaccttggaagtgggggtggggtaaaggtaaagccaaaacaggagagtttatagaaagtttgtttaaatgaacagttgatcttcaggtcatgtcctctaccctagcataaaactggtgctttattccctggagaacataaaacagagggtctccggactggggagcattgggcacagttgagatgtgaatgtgatcttgaaaacagataaaatgagtgtatgcatactgaatgctgagacgcccagtcttcattcctcactcagctaacagaatgctgcctacctgccctgaacct

SEQ ID NO: 70311 - DNA, 768 bp, Homo sapiens
agattctgaggttagcagtaagctattggtgcaccactgcactccagactaggcaacagagtgagaccctatctcttttaaaaaaaagagttggaatcagccagccacggtggctcacacctgtaatcccagcactttgggacgctgaggcgggcagatcacctgaggtcaggagttcgagaccagcctggccaacatggcgaaaccctgtctctacaaaatacaaaaattagctggacgtggtggtacttgcctgtagtcccagctacttgggaggctgaggcaggagaattgcttgaacccaggaggcagaggctgcagtgagccgagatcgtgccactatactccagcctgggtgacagagtgagattctatctcaaaaagaaaaaaaaagaaaaaagaaaaaaatggaatctatacctaaaaaacctggctgctaaacagttataattttgccatttgaggtgtagaaaattaccttaggagttttaccttagcacctcttttaaacctgttgaaatgaaacatttttcaggtaggattttttcagcagtatacatttgtgtgatgatctatctccaattctttgtctttgattttttttatttctcgtggctgtcttctttccaatcaggatgttgagaacgatgggcctgagccctcagactgggaccggtttgccgctgaggagtatgagacgcttgttgcagaggaatctgcccaagcacaattccaggaagggtgagtaagtttccctatgtcttatag

SEQ ID NO: 70312 - DNA, 1359 bp, Homo sapiens
gaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcat

SEQ ID NO: 70313 - DNA, 6794 bp, Homo sapiens
gaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70314 - DNA, 4976 bp, Homo sapiens
cattttttttggaaagtgccttccccggggccgaggtccaccccttccccactcccgccagcttcttccctccacctttcaagtgtccccgcctttcccgtcccagggaaagtggaagcccatgtccagaacatccgcggttactgtcctgaagactcccagatacctgtagtaatcatgacaactctaacagaatgaactgctgtcatggatattgaagaacagaaagcagacatttatgaaatgggggaaaattgcaaaggtaatgtaactactaaaatgattgtacaatctcccgttcgtttagaaaccctgagccccttccccaaatacttttcggatatatatatttaaaaggaacttgtttttgcctgttgaaagagaggtaaaagtcacagaaagaccaagaactgtcttcaaaaagaatgtattaatccagttccaacagagtgagaatacaccttgagattcttaatatatcaactaacattgctctttgagtcttttgaaatgtctgccaaatagttgatggagaaacctatgtatttttttaaacgtaaatctatgtaaacttgagtactggcagataattaataaattaattaatttagtgcagataagcattccctagaaacatgcttaccacctttaagagtacagtgagcccttaatctctcctgtctctgattgtggtttcttatattgctggtgagaattttcagtaaatgaatactgtttaaattttttgtgtctcataatcttatttttcttttagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatatgaatcatgttcattaagg

SEQ ID NO: 70315 - DNA, 5650 bp, Homo sapiens
gaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttatcagtgtgtttagattttgaatattgtgtttccgtcgacc

SEQ ID NO: 70316 - DNA, 707 bp, Homo sapiens
aaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaaggtaagacccaacaattttgagtcctaggaactctttaaaaaatgtttagtgtttgaaaattttataaagaaaaacttttttgttagc

SEQ ID NO: 70317 - DNA, 2423 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70318 - DNA, 669 bp, Homo sapiens
gaatctcggaaaagttgtgcagtcaaaggaagcggcgaggaatctggtgttctcgtgtcaatgagctccaggaggtcggcccaggcttcattgaggccatccttccattcagcgatggtggcggcatctgaatgtccagagttgatgagctcatctgccaggtgattgaccgtgtccacgcgctcctgcccaatgttcccggtgtctcgggcaaactcccggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70319 - DNA, 485 bp, Homo sapiens
agtaacccattagtcatttgcttgtatgatccagcatgggaattccggcctggggtctctccagttttggtaacatgaagctcgtgtgttgcacgcccaccaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtaaatccagcagaaatgtttctctctccatgtttcatgtctgtagaagaaacgtgaggttatttccatgaaggattgaaaaactttcttatatacacagtaacttttttactgtcctcctttctgcaaagggacaagtatgtttaaagcgttttttaaatttacttttttcgtgttgacaaataaaaattctatatattgaaaa

SEQ ID NO: 70320 - DNA, 817 bp, Homo sapiens
cagccctgaggacaacaggtttgtagttctcggcgtggtacgcgggtgtgagcgtggtcatcttgtgtctgttcatggagtactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaaaaaaaaaaaaaaaaaaaaaaaaaaaaaaaggcgaaaagaaaaacacagccagcaacaacgcagagcagaaacgcaagaaaatgagaaaagacaggaaaggggggggccgacggatataaggattaccccccgagaggggggggcacaaccacaagagcgcaccccggctgttagtggaccagaaaaaggagggcgaccgaaaagaggaggcggcgtctaacacaaagcgggcggagcggcgcggccgcagttaacaaaacacggtggatgaaggggagaaacaacgacgccacgtagcagacgactgttgggggagaagcaccgcaacacgcaggcggggggaaacaaaagcggggccaaccacgctcgcaagaagaaagtcgagcgccctggcgacaaaagtcaac

SEQ ID NO: 70321 - DNA, 301 bp, Homo sapiens
gatctgcgaccattatgtgtacacatcagagttataaatggaaagattacatatctgattaatagtttctacatactgtgcatatagcacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70322 - DNA, 424 bp, Homo sapiens
taagcagagtagttaataaaaagcttttttttttcatgttttaaaaatgtgacgttgtcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcac

SEQ ID NO: 70323 - DNA, 326 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacgatgttgggatcatatacgagtcgtggcaagaaagggatcctctagaaacctgcagcac

SEQ ID NO: 70324 - DNA, 2712 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaggctggaatccaatgcacatgattttgacctcccgccagcgtgcgcttccccgcgaagtctggcattctccgaaggaagccgcctgggtaggagggttccaaccgccgccccgtgtggcatctttgctgcaggaacaagaacagtagctcccgggaagggaggggtgtcatgagcagaaaatgaaggagagaagaccttctctcccacccacacacaccttcctgtcctgggttccagaaggttctggggagatggtccctgcagagctttcttcctgggagtctgggg

SEQ ID NO: 70325 - DNA, 4477 bp, Homo sapiens
  misc_feature (7)..(9): n is a, c, g, or t
  misc_feature (14)..(14): n is a, c, g, or t
  misc_feature (1789)..(1789): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataaggtgtgtggcccctgacccctgggagggacctggcgtctgtgtggccacgcccctggggtggggactcctggaggtcacgcagtgggttttcagaacctgcctgggtggggacttgcagaaggcaactgtgcctcccctgggttgagggcgtggatgctagagccagaacccctgggtgtgacccccagccctgctgcttccccgtgctgtgaccttgggccccaaggtgctgtccgtccattctgtggttcagtgtccccattttaaaatgaggacgatgataatacccacgtcctggggctgtcttcagaatcacatgtgtcccttctcacgaggtgcctaaagcagagacgggcgtcctgagagcccagcgttgactctggcactgcagcctcctggggcctgcttgggtgggttgttgggtgctgtgggcaggggccaccgcctccgggctccatgttctgattgccctgcagccttggacctgcctgctggctctgggattttttaagacgaagtcaacaggtaagacttccagtttctagtgagcccactttgcttgttctgctggttggtctggttttattctggggcagggtagggatttttttttttttttttagtgcaaacaacaaaaagcatttcatcactctgcctccatggggagcttagtctgngctagccagaggcaaggtgggcacagtggctggtgggtcagctccacctttggaggctcagcggaacccagcccatcagcattcagggtcacgctcaccatcttgccagcattgtaatcatgcgtatctgcagttcgtcggtggagtcagcctctgacacgccccgcagtgaagtgtcttttttccctctgaaaaatccattcatcctgccacgtgcgggtatttgtcctgaccccatggaaagtgctgacacccacgtgcatttctgtggacgcctccttgaggtctatgggtggagcttggctgatccatgggcatgctgcttctccgaggctctgctcacgctgtctgattggtccattccaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggtgcccccgcctgggccggcgtcccctgggggtgggggtgcagggagcactgggacaatcactacaggatgtgcaggtgcccccacctgggccatcgtctccatgaagctcatggcaccggttacctagggacagccagtgctggggtcacagcctgtatgcctcactgaagacgtcggtcatgcagccttgttaacaaggagggggtctgtgtgtgtgttggtgcatgagcatgtgatgtgtaagagcaagagcgggggtgtaaggatgtgcgtgctcgagtgtgtgcatgagcctgagtgcaagagcaagagggtgtgtctgagcctgagtgtgagcctgagcgtgagaggttacatgagtgtatgagagtacaagtgtgtgaatgtatgcacaagtgtgggtgtgcttgtgagtgcttgtgcaaaagcaagtgtgagtgtggatgtgtgagtgtgcacaaacgtgagtgcacagttgtgtgcatgagtgcgtctgcatgagtgcacgagcatgcctgtgagcatgtgggtgggtgggtgtgcatgagtgtgagagtgcacatgactgtgtgtgagtgtgtgtctctttaatcctcagggaacagcccagacgctgtctgcctcctgagctactgcacttgactgactgctccgtgatgggcagaggaaaagagaggccgggggctccagctgctgggatctgtcctgtctctctctgtcccctttctgctgtgcctgggtggcctctcccctcctgccagtggtaaagggatggaaatgcagttgccaagctttctcccagggaccccacggctcagtcctgccaccagtgctccctctgccctcccgggctctgggtgctcccatctttgaaggcaaggcaccactgagcttgtgtgagccctgtggaggtgggaccaccccgagaggaaggcctcgggacactgtgggactctgagactctgatgttccccgaacgctagagagctcctaagctattttaattttcttgttttcaagagtttgtgggtgtgcgtctcccccgtgttcctttgcaagggaacccgttatttcctctgttgtgttttccaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtaaatccagcagaaatgtttctctctccatgtttcatgtctgtagaagaaacgtgaggttatttccatgaaggattgaaaaactttcttatatacacagtaacttttttactgtcctcctttctgcaaagggacaagtatgtttaaagcgttttttaaatttacttttttcgtgttgacaaataaaaattctatatattgaaaa

SEQ ID NO: 70326 - DNA, 2257 bp, Homo sapiens
gagtggcactttgcacaagaatattaacatgacgtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70327 - DNA, 2965 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaaggagtctgttacccacgtcacatcgtggatgccccctgcccggataggtctgagtgcactggggtggccggcaccccacaccttctcagggagcacccagcaggatacctgagattctccttaggccttggatgggagctggaggcttctggctgcctcctgcaccccagatgtgtggcaacggggtggggagtgtgtcacccgaaagatgatcaggtgaggctgggaccctgaaggcagccccatcctgtggaattaccctcggaggctccaaaacttcccacctgcaggaactgagctcaggggcaccagaccctggtccccaaccttcaagttatagggtggtgtcccccagttacagggcagtgtccccagttacaggatactgtccctcagtcataggttagtatcttctggttacaggatagcatcccgtcagttacagggcagtgtccccccagtcatagcatagtgtatccccaagttacagggtagtgtccccagttataaggcaatgttcccccattatagtgtccccagttatgaggtaatgtctcccagttacagggtaatgtcccccagttatagggtgatgtccccacagttatagggtgatgtccccacagttatagggtgatgtccccacagttacaggtga

SEQ ID NO: 70328 - DNA, 2672 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcac

SEQ ID NO: 70329 - DNA, 2345 bp, Homo sapiens
  misc_feature (7)..(9): n is a, c, g, or t
  misc_feature (14)..(14): n is a, c, g, or t
  misc_feature (2199)..(2199): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagtcgagnggtcagcgcacagaagccctgtcgtacattgtctataggtgtgtgacttgagtaatgttatcaacgtttttgtaaatatttactatgtttttctattagctaaattccaacaattttgtactttaataaaatgttctaaacattgc

SEQ ID NO: 70330 - DNA, 1603 bp, Homo sapiens
tggtggccagggtgctgtcactttgggaagcagccagagaaccacaggatgcgtgaatcggtctccttgtcttcatgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70331 - DNA, 2311 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaaccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70332 - DNA, 1204 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtgcattgcctgactcgtctttggacccgacggccttccactctgctctttttgggaatgggcattaaagcagcggattcaccgaggcaggcggtagcaccggaggcgagttctgcagctggctttgcaggagcagggcgagcttgtgtcctggcgtcgccgactctgcgaggctgtctgagcagttcattgctttgctcccgctgcgttcccatcctcatgattctgtctggtgctttctgcacagcataggtgtggtcagcacggaggcggttacaaaaccaaaccagtttca

SEQ ID NO: 70333 - DNA, 1425 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgtaagtgccagtgtgagtgtggaagggcaaacctgggacaaaggcaagctcaagggcatgacccacccaaccggcctccatccagggtgtggaacatccatgtgtccagggatacgaaaggccttatgcttgaaaagtgggttttgttcctatctcagccccgtaagccacctcatttcccctgcaaggagggagctcctgaaagcaggatgtgtcagttcttccagaaagtcctgtgcacacatcagcagactctgcacaaaggggaatgcagcattcaccccaccccgtgcagagagcttgactcacatcacagggagccctggggctcattccatgtccacatgttgccacacggttcccatgtcctaggctgcatatgtgtagctccacaaggaaggcctctgcatgctccatgctggtgtctgtgctgtaccctgcatcgccggtccttatggaggcctctgcacacgctgtgctggtgtctgtgctgtaccctgcatagccggtccctatggaggcctctgcacgctctgtgctggtgtctgtgctgtaccctgcatagctggtccctatggaggcctctgacaacgctgtgctggtgtctgtgctgtaccctgcatagccagtccctgtggaggcctttgtgtgtgctgtgctggtgtctgctgcggtccctgcatagccgcccctatggaggcctctgcatgagctgtgctgtgccctgcatagctggtccctatggaggcctctgtgtgcgctgtgctggcgtctgtgctgtccctgcatagccggtcccctatggaggcctctgctcacgctgtgctggtgtctgtgctgtccctgcttagccacccctatggaggcctctgtgtgtgctgtgctggtgtctgtgctgtccctgcatagccggtcccctatggaggcctctgcacgtgctgtgctggtatctgagccctgctttgaatagccggctccctatggaggatgctgtgctggagtctgtgctgcgcactctgcatagccgtcccctatggaggcctctgca

SEQ ID NO: 70334 - DNA, 1151 bp, Homo sapiens
cttttccagcacacacgcccagcatctggtggggactctggtaatttactttttcacctctgggacttgtgacccgcttttggtgcgtgccagtgtttcaacagccccacagtccgtctttgcggggctgtggtgtcacaggcctctctttccaggtgctacagctcgagagggcagagccacagtccctggacggcgtggactgaggccggttccttcctggaggcctcctgtcctcggggaccccagcacctcatcatcagcattgctggagccaagggtgaattacttggaaactgcacaacacacccgctgttttcaacagagttcagtcacctcttgagggctcttctgattcttatcttggtagagcatctcctcaaggatttctgcaggtgagtacactggtgaaacaatgcccaatcgcacggccaagagatttgaggagcagggacatctggctgtggttcttgtggctgctcccagtgcagctgctataagccctgctgctgctcctcaggctgtgggtcatcctgctgccagtccagctgctgtaagccctgctgctgccagtccagctgctgtaagccctgctgctgttcctcaggctgtgggtcatcctgctgccagtccagttgctgcaatccctgctgctcccagtctagctgctgtgtccccgtgtgctgccagtgtaagatctgaggctctggactcaggtctcatgtgagtcctgctaaccccattttccgaagctgtgacctgtccttcatcgttgagccccaaaccactgctcagggtccattcctcactataagatgaagccatatctgcctgccttttcctaaggagagtccaccctaattaatgtccattccctcctaacaaattctcttcccaagtcaactgcaactgcggctgaatcacccctcacccgctagccttgcctttgcttgtgtattcagaggcctgagctcctgaacccacttgaagtcctgtcttttccagctggagcagctgggcatgagtgtcccacctgcaacaaggtgggcgtttaagaggcttccttggagtggctttgcctgtccaacactctgctttatcttaaatgaaaagttgcaaactaataaaaataccatgccgacaaactgaaa

SEQ ID NO: 70335 - DNA, 503 bp, Homo sapiens
tcccttccagacacagcacagcacacacaaaggcctccacagggactgctgtgctggtgtctgtgctgtaccctgcatagccagtccctgtggaggcctttgtgtgtgctgtgctggtgtctgctgcggtccctgcatagccgcccctatggaggcctctgcatgagctgtgctgtgccctgcatagctggtccctatggaggcctctgtgtgcgctgtgctggcgtctgtgctgtccctgcatagccggtcccctatggaggcctctgctcacgctgtgctggtgtctgtgctgtccctgcttagccacccctatggaggcctctgtgtgtgctgtgctggtgtctgtgctgtccctgcatagccggtcccctatggaggcctctgcacgtgctgtgctggtatctgagccctgctttgaatagccggctccctatggaggatgctgtgctggagtctgtgctgcgcactctgcatagccgtcccctatggaggcctctgca

SEQ ID NO: 70336 - DNA, 3417 bp, Homo sapiens
  misc_feature (7)..(9): n is a, c, g, or t
  misc_feature (14)..(14): n is a, c, g, or t
  misc_feature (1789)..(1789): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataaggtgtgtggcccctgacccctgggagggacctggcgtctgtgtggccacgcccctggggtggggactcctggaggtcacgcagtgggttttcagaacctgcctgggtggggacttgcagaaggcaactgtgcctcccctgggttgagggcgtggatgctagagccagaacccctgggtgtgacccccagccctgctgcttccccgtgctgtgaccttgggccccaaggtgctgtccgtccattctgtggttcagtgtccccattttaaaatgaggacgatgataatacccacgtcctggggctgtcttcagaatcacatgtgtcccttctcacgaggtgcctaaagcagagacgggcgtcctgagagcccagcgttgactctggcactgcagcctcctggggcctgcttgggtgggttgttgggtgctgtgggcaggggccaccgcctccgggctccatgttctgattgccctgcagccttggacctgcctgctggctctgggattttttaagacgaagtcaacaggtaagacttccagtttctagtgagcccactttgcttgttctgctggttggtctggttttattctggggcagggtagggatttttttttttttttttagtgcaaacaacaaaaagcatttcatcactctgcctccatggggagcttagtctgngctagccagaggcaaggtgggcacagtggctggtgggtcagctccacctttggaggctcagcggaacccagcccatcagcattcagggtcacgctcaccatcttgccagcattgtaatcatgcgtatctgcagttcgtcggtggagtcagcctctgacacgccccgcagtgaagtgtcttttttccctctgaaaaatccattcatcctgccacgtgcgggtatttgtcctgaccccatggaaagtgctgacacccacgtgcatttctgtggacgcctccttgaggtctatgggtggagcttggctgatccatgggcatgctgcttctccgaggctctgctcacgctgtctgattggtccattccaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70337 - DNA, 2306 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatggcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70338 - DNA, 3180 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtgaattacttggaaactgcacaacacacccgctgttttcaacagagttcagtcacctcttgagggctcttctgattcttatcttggtagagcatctcctcaaggatttctgcaggtgagtacactggtgaaacaatgcccaatcgcacggccaagagatttgaggagcagggacatctggctgtggttcttgtggctgctcccagtgcagctgctataagccctgctgctgctcctcaggctgtgggtcatcctgctgccagtccagctgctgtaagccctgctgctgccagtccagctgctgtaagccctgctgctgttcctcaggctgtgggtcatcctgctgccagtccagttgctgcaatccctgctgctcccagtctagctgctgtgtccccgtgtgctgccagtgtaagatctgaggctctggactcaggtctcatgtgagtcctgctaaccccattttccgaagctgtgacctgtccttcatcgttgagccccaaaccactgctcagggtccattcctcactataagatgaagccatatctgcctgccttttcctaaggagagtccaccctaattaatgtccattccctcctaacaaattctcttcccaagtcaactgcaactgcggctgaatcacccctcacccgctagccttgcctttgcttgtgtattcagaggcctgagctcctgaacccacttgaagtcctgtcttttccagctggagcagctgggcatgagtgtcccacctgcaacaaggtgggcgtttaagaggcttccttggagtggctttgcctgtccaacactctgctttatcttaaatgaaaagttgcaaactaataaaaataccatgccgacaaactgaaa

SEQ ID NO: 70339 - DNA, 2420 bp, Homo sapiens
  misc_feature (7)..(9): n is a, c, g, or t
  misc_feature (14)..(14): n is a, c, g, or t
agcgggnnncgggnccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttctggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccacgtgctgcgcaaagccaacaccagggtggatctcgtgactatggtcaccagcaagaacggtgggatttacttgctggccaaccagaagggttgcgacggggaccgcctgtactacgacggctgtgccatgatcgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggctttattccagcctctttttgaggaatttgactgaaaagttccctccctcaccgctgatgcgccgtcccatcctgggcgtcgac

SEQ ID NO: 70340 - DNA, 1711 bp, Homo sapiens
atcgggaatgtttccactttctgtctatcattaacaattctgctacaaacatacatgtacttctgttggaggggacacatgttttcatttctcttgggtgtgtctatccaggagtggaattggctgggtcttatggtaactctgttaactgttttttgctttttggttttttgtttgttttttgagacggagtttcacccttgctgtgaactaccataggctggagtacaatggcgcaatcccagctcagcacaacctctgcctcgtagattcaagccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70341 - DNA, 2705 bp, Homo sapiens
  misc_feature (1077)..(1077): n is a, c, g, or t
atcgggaatgtttccactttctgtctatcattaacaattctgctacaaacatacatgtacttctgttggaggggacacatgttttcatttctcttgggtgtgtctatccaggagtggaattggctgggtcttatggtaactctgttaactgttttttgctttttggttttttgtttgttttttgagacggagtttcacccttgctgtgaactaccataggctggagtacaatggcgcaatcccagctcagcacaacctctgcctcgtagattcaagccagcagggcgagcccctaccccagagtgaaggtggactttgccctctcgtgccacgaggacttgctggcacccatctctgagcccatcgagtggaaataccacagccctgaggaggagataaggtgtgtggcccctgacccctgggagggacctggcgtctgtgtggccacgcccctggggtggggactcctggaggtcacgcagtgggttttcagaacctgcctgggtggggacttgcagaaggcaactgtgcctcccctgggttgagggcgtggatgctagagccagaacccctgggtgtgacccccagccctgctgcttccccgtgctgtgaccttgggccccaaggtgctgtccgtccattctgtggttcagtgtccccattttaaaatgaggacgatgataatacccacgtcctggggctgtcttcagaatcacatgtgtcccttctcacgaggtgcctaaagcagagacgggcgtcctgagagcccagcgttgactctggcactgcagcctcctggggcctgcttgggtgggttgttgggtgctgtgggcaggggccaccgcctccgggctccatgttctgattgccctgcagccttggacctgcctgctggctctgggattttttaagacgaagtcaacaggtaagacttccagtttctagtgagcccactttgcttgttctgctggttggtctggttttattctggggcagggtagggatttttttttttttttttagtgcaaacaacaaaaagcatttcatcactctgcctccatggggagcttagtctgngctagccagaggcaaggtgggcacagtggctggtgggtcagctccacctttggaggctcagcggaacccagcccatcagcattcagggtcacgctcaccatcttgccagcattgtaatcatgcgtatctgcagttcgtcggtggagtcagcctctgacacgccccgcagtgaagtgtcttttttccctctgaaaaatccattcatcctgccacgtgcgggtatttgtcctgaccccatggaaagtgctgacacccacgtgcatttctgtggacgcctccttgaggtctatgggtggagcttggctgatccatgggcatgctgcttctccgaggctctgctcacgctgtctgattggtccattccaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70342 - DNA, 672 bp, Homo sapiens
tcagctcggtaccattaggcgcgtctggtccagcgcttcagcttcctgcctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaaga

SEQ ID NO: 70343 - DNA, 1066 bp, Homo sapiens
ccacgggccgaccagccgtccgcagacccctgagtcctctgcctcgcctcaaacccctttcaccccttgccctcgccgtccctggtttgagccagaactctcccgcgaagccctctagaggaccacgtgccttagggacaggctgggggcggcctccgtgcgagtcgtggttgttcgcagagcagcacgtcctctgcctgccaaaatcccggcttctttgagaatcttgtcactggacaataccatccttttcctttcagcctgtaatttatagatttcctattcctagtgagttttgtcatgattagttcttcaaagactagctcctacttgaaccttcacctcaaatcctggcatcgacaaactagtttccccccgcccacctccccacccccccgccacaaccccaaatattgccatctgccagaagattgttttaataactgtccaaatcctcagtgactgtggggtgcttgacacaacttggagttgtgttatgcacaactgtggttgaacttgaactccaacatccagtcccctccttcctgtaacttcatctccagtaattatttctccccttcagaatcagtccttgctaccacagttctagaccatgtcatcattagaatccgcatcctctctacagtcttgtctgtggtgaccatggcctctcagatctcctgctccacggagcggaagtgactgacaggtccccctgccttcccaaggcatacactgctgggtttgcactgaagccatgcttctctggcactactcccagtcagtgagcgggcacagcacggggtgttggtggtggcacgttcatggaagatgtaggactcctctgatgagcaagtttggcttggaaacacctgagccggctggttgaaactttctgagaactatgctgcatgcagcctgaggctcttgggcccagttcccctctcctttcacaggtgtcagacctgtattatgatatgaagtctcccttccccgctcctgcttccttctgtttatccttcacaggagttcccttaataaaactcttgcacattgaaaaaaatct

SEQ ID NO: 70344 - DNA, 357 bp, Homo sapiens
gtctcggctcactgcaacctccgcctcccggcttcaagtgattctcctgcctcagcctccccagtagctgggatcacgtagcgcccgccagcatgcctggctaagttttgtatttttagtaaagacagggtttcaccatgttggccaggctggtcttgaactgccgaccttgtgatccgcccgcctctgcctcctaaagtgctgggattacaggcatgagcccggccgaaatacaatttaattaaaatacttattttcttattagaaagctgcctctcaatggcacctactgctacatttacatagtaacccaaaattgcagttgcttagcagggagagaatcacagtgctggatat

SEQ ID NO: 70345 - DNA, 303 bp, Homo sapiens
gatggcacctgtttcctgttagagatttcttaagggagattgtgaataatcaccagtgattttagtggcagccaagtgacactgaagcttggcagatgtctgtcaaaaccagctacgggactggacagcgaggaccaggagaaaaatgtttgttttttttaaaagatactctggtattcgtatgacaagacccattttgttatgcccaagaacaaggggagaacctcatcttcgccatacttgagtctgactcagtgtggctgtgactcatccttctaggacagttcccctgccacaatagcg

SEQ ID NO: 70346 - DNA, 1326 bp, Homo sapiens
agcgggccacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccggaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatgaaaaa

SEQ ID NO: 70347 - DNA, 1387 bp, Homo sapiens
agcgggccacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccggaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatgaaaaa

SEQ ID NO: 70348 - DNA, 860 bp, Homo sapiens
ttttgttcctgcattaattcactcaggagggaaaattttatttattttttaattaattattattattattattatttagatttttgagacaggttctcgctgtgttgcccaggctggccttgaactcctgggctcaagcaatcctcctgccttgtcctcccaaagtgctgggattacaggcatgagccaccatgcccagcctaggagggaaaattttaaattacatgtgtggctcacattgtatctcttctagacagcaatgctctagagaaatgtttaccagaagacatacgctagaaggctcataaataacattattaataataccttccaaaactagaaaagaattcaaatattcatccagaatgggacagataaattgtggcttattaatacaatggaatacatacagtcaaaaaaatgcagtaataatgacagctacataaaatgtggatgcaccctgaaaaaatgttggcagaaagaagccagataaaaagaatacatacaatgggattccattcacaaagtcagacaaaattaaatacaaaaataaaaaataaacaaattcagaacaaattaaacaatggtgttaagggatacacgctgagatggaaaaactattaagaaaatcaaaacaggccaggcgcggttgtttcttataacatctttccataaaaagccaagggccccactcagtgaaaatgattgaacatgagaattaagataatgtctaactgggatggattctttttctgtgattatgattttgttaaataagctacaaagcaatttgaacatcaagcatcaaagtttcttatgccaaacttcttaatttcaaatatgaaaacagtcataaaaat

SEQ ID NO: 70349 - DNA, 193 bp, Homo sapiens
taaacaaattcagaacaaattaaacaatggtgttaagggatacacgctgagatggaaaaactattaagaaaatcaaaacaggccaggcgcggtggctcgcgcctataatcccagcactttgggaggccaaggcaggcggatcacaaggtcaagagatcgagaccatcctggccaacacggtgaaaccccgtct

SEQ ID NO: 70350 - DNA, 387 bp, Homo sapiens
ttaaaacctgggtgctccaaaagaactgcttcatttttgatagccactggacaattgtttataattattttggagctgcaaacccctttgaatatctgataaaagctatgattcttttcccagagaaatacattgtacacaaatttttgcatacaatttcaatttgcatatacctcttgaaacctatctgtagatcctataatagtgatcaaatttcaatgagtatgtaactcacctgggattgcttgttaaaatatagatgacctattctcactgcccaaagtttggtgcattaagtctggagttggacttaggactctgtctactcctccctactccctactcttttctcttttttcaaagagacagggtcttgttgggctcaag

SEQ ID NO: 70351 - DNA, 334 bp, Homo sapiens
aattctggagggaaacctgaggtttctggagcactaaatataacaagcagtgacatagttgaaccagtgatgtcgaagccagcaaagcccccatgtgtggagcttggtgtatttctggttcagacagaaatagacacctaccagagggcatgatggcatcagtgcttgcgggcagccttgggccaaacttagtctccatccctgctgcctggccctctcctcctgccttttcctctctgctccttggggagctccatctagcacccgaggattgtggttttgcttctggctgcaagtactttcacatatcctgttgctcatgagagggtggagg

SEQ ID NO: 70352 - DNA, 335 bp, Homo sapiens
gaaaactctcctttccttgtgcagttccccaggtgtctttgcccctatagaaaatgatgaaaatagggcagagaagagctgtctccaagaaagctcctcttggaggcttgaagagatagcctccaagaaagccatgtttgtcagcctgtcctgtgcccttttccagcccttctggttcctgcctcctccctcacaaggtccaggccttaccattcttcctcacagtcctgggttggccaggcggggagctccttgagacaaagagcaaggagaaggaagtgcttctactcatgtgtgttctgtcccaaggcgtgggacctgcagatgcctgtcaa

SEQ ID NO: 70353 - DNA, 319 bp, Homo sapiens
ctttgagtgcagtgggacctcagaggctaggggtagccatttgagcatctcctgtgtaccaggcactgtactgggcactaagaatttaaaaataaacaagacaccgtccctacccttgaggagctcaccaactaggggtgaaatgtccaggacacactctctgagttcctagggctgcagctaaccttagccagaccagagcacagatgagctcgcagccagactctccaggccagatacgggccaggcagcagcatccgttcaacagaatcgctgagcagttctgttgtgccagacaaagcagtcacactagagatac

SEQ ID NO: 70354 - DNA, 289 bp, Homo sapiens
ctcaaagaaacataccacctcaaagacacaggcataccgtgccttcctaatacacaaatgaggattagaaaaacagagaactacccatgttgccttgccctctttcctcaaaccacactagcaggcacaaagtaaacaagcaagaagagtctgccactgggagtgggtaaacagcacgccgagagatacatgtagaataaatataaaaattaaaacaatactggacacattgtattcaaactccttaaaaccaaagctaaagagtcaaagttacagatagccatccaga

SEQ ID NO: 70355 - DNA, 414 bp, Homo sapiens
gataaaagggaaaataaatataaagtactgctgcatattgaataagatagttgtctttaggaaaagcacttgtgcagttatttaagttgccagctgaattcattgctttttatggaatactatttttgcttgaatggaccatttacagatatgctgtgattatcagactggttattggttattagttattgattactcaagactggtttttggttatttggcgcacattttttccaaagcgaacaaattaagcctgtcatgttaaacaactgacaccatctattgccattgataaaatatgaaatgtcaagtgaaaattagaatttttagaaacatatatctggcactatgtggttgaagctttttctttttttcttttcttttcttttttttttttttgataaggtgttactc

SEQ ID NO: 70356 - DNA, 2952 bp, Homo sapiens
  misc_feature (610)..(610): n is a, c, g, or t
gaagcgaatagcgttttcagagatattgggcggctcaagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagcngtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattatcgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 70357 - DNA, 3032 bp, Homo sapiens
  misc_feature (690)..(690): n is a, c, g, or t
aagagatgtgggctctggggcgctggattcagtaacttccgtcgggttctagactggctcggctctgtccagttgtgccagatagtctcccacccgctccccagccctcctttcccctggagatttgaacgctggttgctgggagaaaagctattagagaaaaagagtccattagtaacagaagaagagtcttggttaaaagttgtcatgaattggttttggagagaggcgaagcaagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagcngtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattatcgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 70358 - DNA, 2836 bp, Homo sapiens
  misc_feature (494)..(494): n is a, c, g, or t
cctgactcccccggctcagcccccggacggtggggacccgagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagcngtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattatcgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 70359 - DNA, 738 bp, Homo sapiens
aatgatttcaattgtcggcttcaaattcaccttatttcttctaccccagcatgccttttttgtggcagcacttagattctcatatcagaaaacaaacgcattcatgccgtaccagtgattcgttggggaaactgcctcggccccaccacccagatcccccacgttcctaccaagtaagccaagtgaccatgtgaagaactgactgacacccagaggaaactaataaacaaaaacaaataaaagcaaataccttttcaggaatctcacttggaaaaccaagtataatggcaaaaaacaaccaaaaaaaaaaaacccgaatgttttcagcgttggggatgttgggggtgtagacatctcgagagctggtttccgaaggcaccgcaccccagacaatgtgctacaagagcctcccggctgctgtgtcaatgaagcctttcaggccctccacactgcttcacttgttccctaaagtagtgctttctggaagctaaactctcagctggcgagaacagtgaactctgtgccatttgtctatcaactcctttaaaaagaaaaacctcctgtacggctctcttgttttgcattttctattctgcactccagtacgcataacgacacacagaagaggcaagggcctcttttaaaaccgtgaagaaagaataaatttgaaagcacccagaagcctctgctttcagctattagagaaaagtttgcatcccatagaaaccagtactaatt

SEQ ID NO: 70360 - DNA, 2189 bp, Homo sapiens
  misc_feature (1)..(1): n is a, c, g, or t
  misc_feature (43)..(43): n is a, c, g, or t
  misc_feature (1552)..(1552): n is a, c, g, or t
nggatgagcctctgtgaactactaaggtgggagggggctatangcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctncttttaggtcatccaacctctttcctctctggccactctgctctgcacattagagggacagccaaaagtaagtggagcatttggaaggaaaggaatataccacaccgaggagtccagtttgtgcaagacacccagtggaaccaaaacccatcgtggtatgtgaattgaagtcatcataaaaggtgacccttctgtctgtaagattttattttcaagcaaatatttatgacctcaacaaagaagaaccatcttttgttaagttcaccgtagtaacacataaagtaaatgctacctctgatcaaagcaccttgaatggaaggtccgagtctttttagtgtttttgcaagggaatgaatccattattctattttagacttttaacttcaacttaaaattagcatctggctaaggcatcattttcacctccatttcttggttttgtattgtttaaaaaaaataacatctctttcatctagctccataattgcaagggaagagattagcatgaaaggtaatctgaaacacagtcatgtgtcagctgtagaaaggttgattctcatgcactgcaaatacttccaaagagtcatcatgggggatttttcattcttaggctttcagtggtttgttcctggaattc

SEQ ID NO: 70361 - DNA, 1516 bp, Homo sapiens
  misc_feature (1)..(1): n is a, c, g, or t
  misc_feature (43)..(43): n is a, c, g, or t
  misc_feature (1514)..(1516): n is a, c, g, or t
nggatgagcctctgtgaactactaaggtgggagggggctatangcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcaggtacgcagtctctagaattaggtatatctactggggatgacataaaaattataaggctttgtgctaaactaggagtttaatccattatagaggatgagaatggagggaagnnn

SEQ ID NO: 70362 - DNA, 318 bp, Homo sapiens
catttgtcatcctaaaagaaagaagctgaggtacaaaatataatttagagtttacttgagccaaagttaggaaagcttcccaggacatacttttatgttgccttggagaatgctccattagcttttgttacaagcaggttttcaagggcaaagggagcaaaaagtgggccaatacaagttgtttgacaggaattctcatcagttaacagaaacaacattggtagtgattggctgtacatcactgaactataggttatgagttatggtgtctagcctgtggaatttttatggctacttggtgtcagtcagtcaagagcc

SEQ ID NO: 70363 - DNA, 514 bp, Homo sapiens
ccgcctcagcctcccaaagtgctgggattacaggtgtgagccactgcgcccggcccaaaacatgtattctgttttatggaatgaagtattgcccaattttagaatcacaaataaagtcagttaagatccttaaactggattcgttgtaattttgtgttttgacatatgttacaacatggacaaaccttgaacatattataataagtgaaataggccagacacaaaaggacaaatattggatgattccacttacatgagctacctaaagcagccaaattcatagagacagaaagtagaacggtggttgccagggttgggatggcaatgggaggcagagcgaggagttatgcacccagtttcagagtgtgggatggttaaaaagtcctagccatggcgtggtggctcacgcctgtaatcccagtactttggaaggccgaggtgggtagattgcttgaggtcaggagattgagaccagcctggctaacatggtgaaactctgtctctactaaatata

SEQ ID NO: 70364 - DNA, 556 bp, Homo sapiens
taatcgagctcggtcccccccttactatcatgcagctagtagtagcagaatggtgatttgaacccaggacttttgattccactctacaacactgcccacccccattggaaagcggtcatgtgcagcccctgcctccagagtacagagcctagaggagataagacttgtctttaggaagctagagttcaaagctaagagctgaagggcccatgagaggtccaggtaacaggttctacacatgtaaaggagggagcaggcaatgccagctctggagaattagggatggctacatggaagaggtgaccctggagctgtgtactggtagggaggattttagggtgagcaaggggaagtgactggagtgcagcattttcaccatgagcagatttgtagaggtaggaggggccaggagcacagccagagagagggaaagaggccagttctgcttgagagttgagggggagtgggagagggggccctgcagtcacacagcaggcacttcccatacattgccctcaaataaacaaatgctcattcgtcatgcacattttaaaat

SEQ ID NO: 70365 - DNA, 551 bp, Homo sapiens
  misc_feature (480)..(480): n is a, c, g, or t
  misc_feature (502)..(502): n is a, c, g, or t
  misc_feature (538)..(538): n is a, c, g, or t
taatcgagctcggtcccccccttactatcatgcagctagtagtagcagaatggtgatttgaacccaggacttttgattccactctacaacactgcccacccccattggaaagcggtcatgtgcagcccctgcctccagagtacagagcctagaggagataagacttgtctttaggaagctagagttcaaagctaagagctgaagggcccatgagaggtccaggtaacaggttctacacatgtaaaggagggagcaggcaatgccagctctggagaattagggatggctacatggaagaggtgaccctggagctgtgtactggtagggaggattttagggtgagcaaggggaagtgactggagtgcagcattttcaccatgagcagatttgtagaggtaggaggggccaggagcacagccagagagagggaaagaggccagttctgcttgatgtgattatttgacattccatgcttatttnaaaatattctcaggtatcccanaaatctatatacctactatgaacccacaaaaatttnaaattttaaaaat

SEQ ID NO: 70366 - DNA, 642 bp, Homo sapiens
  misc_feature (3)..(3): n is a, c, g, or t
  misc_feature (29)..(29): n is a, c, g, or t
ctngcccctacggccactaagctgcgaanaagacgacagaatgggacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcaaaaaaaaaaaaaaaaaaaaaaaaaacaaaaaacaaaaaaaaaaaaacaaaaaaaaaaaaacaaagaaacaaaaaaaaacaaaaaaacaagaagaagacggggggcggcggcgcacataaataatatcccgccgcaggggggccaccgcaccgtgacgcgtgcccccgccgttttttatacgacagaggggggccccat

SEQ ID NO: 70367 - DNA, 444 bp, Homo sapiens
  misc_feature (3)..(3): n is a, c, g, or t
  misc_feature (29)..(29): n is a, c, g, or t
ctngcccctacggccactaagctgcgaanaagacgacagaatgggacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtca

SEQ ID NO: 70368 - DNA, 607 bp, Homo sapiens
  misc_feature (3)..(3): n is a, c, g, or t
  misc_feature (29)..(29): n is a, c, g, or t
ctngcccctacggccactaagctgcgaanaagacgacagaatgggacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaaaaaaaaaaaaaaaaaaaaaaaaacaaaaaacaaaaaaaaaaaaacaaaaaaaaaaaaacaaagaaacaaaaaaaaacaaaaaaacaagaagaagacggggggcggcggcgcacataaataatatcccgccgcaggggggccaccgcaccgtgacgcgtgcccccgccgttttttatacgacagaggggggccccat

SEQ ID NO: 70369 - DNA, 146 bp, Homo sapiens
  misc_feature (43)..(43): n is a, c, g, or t
  misc_feature (143)..(143): n is a, c, g, or t
  misc_feature (145)..(146): n is a, c, g, or t
gggggcctagatgctccctgtgtgcaatgatctgtgtgcatancctgcctatgtatagatgtcctgggctcagtacacacttgttgaactcaacccaggatgctatgaggacagagaatgtggcttttaagggaccctaacancnn

SEQ ID NO: 70370 - DNA, 563 bp, Homo sapiens
cttaatttaaaaatatattactttcaatcttgtaagaggcagactggtttaagtatctcctgtgctactgatgaaactaggaaaagaaggtgaccatgaatatgaaccaaaatatatgctttcatattattttctcacttatcagagcaccacacacctattaacagtacttgattttaccaaatttttgttctaactagcttaggggggctcccaccatcataagatggttcgtgtttgcaactcatttaaaaatcgcattttttcttctgattataacagtagtatatgtttactatagagaatctagagaaaaatatttattaaaaatagaattcaacaactcaaaaccagatgagattttggtacacttccttctactctcttttttctctgtgtatgtatttatatatgtatatatacatataattataaaaaatatatacctttatgagtatagaattggaatcatggtatatatagctttgtacacttttttctattatgcaaaatgtaagcatctttttatattattaaactatcttggaaaccatggtattaaa

SEQ ID NO: 70371 - DNA, 553 bp, Homo sapiens
cgatacgcaagctcgaaatacccccctaaaaggaacaaaagcggagctccccggggtgcggccgttctaaacaagtggatcccccggctccaggaatcgggcacaagatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70372 - DNA, 485 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaactcccagagcctacctggcttctgtg

SEQ ID NO: 70373 - DNA, 2399 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70374 - DNA, 2431 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaaaaaatgaacaacacaacctcacaccaacacaa

SEQ ID NO: 70375 - DNA, 2345 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtctttatagcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70376 - DNA, 1507 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggaggggctcccgctgtctaagggtccgtcct

SEQ ID NO: 70377 - DNA, 806 bp, Homo sapiens
cggacgcgtgggtcgacccacgcgatcgcgcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70378 - DNA, 772 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccagctgagtcaatacgactgatatctttctgaaatgagctctagtgaggatccttgtgactcaaagcagtgctgttgtcagataactgtca

SEQ ID NO: 70379 - DNA, 2512 bp, Homo sapiens
tttttttgagatggagtctcactgtgtcacccaggctggagtccaatggtgcattctcgtttcactgcaacctctgcctcctgcgttcaagctgttctcctgtctcagcctcctgagtacctgggattaaagggcaaaagcttgctgaccacaaagaacttgtctgtgctgattactgctagatcttggatgtcaaacacagtgaccacattatggatgcagtggaaaattgttaaatgaatgaacaaagtataggtctgccagtttccttggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70380 - DNA, 1997 bp, Homo sapiens
tcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 70381 - DNA, 454 bp, Homo sapiens
ttaaaaaaaagaaaaaacatttcatattttaccctttctatgctctcccttccctgcttatacagcagtcaacattcctgcttctttaccttccattcattccataaccccatctcctaatgctttacgattgtgcctttatctgaagctattacaaaaattaacacagtcatactgtagtacaccaaacaagcagaatggggaaatttgattccacaaatactccaattttgtctatgactatgcctactgatggaaatttggactgcaagagagatgtaattatgagtttctccttggctttaaagtgcagaaaattggaaattggaaacagtaagcctcctaaaattttcacaagttgggcagggggtgagtatcttatatttatgtgtgcagttacattgctttaaaaagtttttccagcctgggcaatatatcaagacctcatctatac

SEQ ID NO: 70382 - DNA, 1035 bp, Homo sapiens
ccaacctttccatttcatggcaaatgataatatttgtaaggtatagaggtaaatggatgaagcttctcacttggaggtggccaatttgggtgcttaggccactatgagggcaggaaaaaattactatcttggccacaattacaaacttcttagactgcagctccattttggttggaaagcattggttaacaaactcaagaaataatgtgtgaacataattttacaagtatgaatacaaattgaagttcataggctttttgcaagatacatgttgaaatatgtggaaattttcttaagggactcttgaaaatatttcgtaatacatttaattagaaaaagctcaactgagaataagaagaattgaatttccatcctgattatttaagctgataagaacagatactacacttgatcttagccaaaaggccgagaagcgattccatcctgattatttattagctgtatgactatggatatgtcacttctcagcttccatatacataaaatgagaagattagctcaaataatctctatagtttcctataatgctaacattctatttttatcttatttcagaattttatttcattctattttagttcagaatttacatgaatattatttctttcaaaatgttcaccttctgaaatgaaatcacttttattgctccttttgtatttacaggcacataaatactaaaatattttgtacatatacttattttcatcatctttggtaagcactgaaatgaatatatttagttcagtattttcaatgctaattaaggaattggtttggtaccagttttcagaacagacttaaagaaccaaaagattataatttcaaagagactaaattatttatattctactctaaaaggatgcttagaacaagaataagtacagcatccaggggataatattgcatgaccattgggcagaagaaatgcatcaaatcatataaactgtactaaattgatatgctttttaaacattgcctaataaaaatttattgttgttattacccaaaaaaaaa

SEQ ID NO: 70383 - DNA, 467 bp, Homo sapiens
cattttggaattaaaactccatgagggcttgaactttttgttccctactacttgtaaaatgcctgatgtatagtagatattcaatttgctgaataataagtgatacttgtcaggccctgttccagtaactttacatgtcttacctcatgatctttgcacagttttgttgaggtaggaagtatttatatcctcattttaagatgagaacattgaggtgcaacatggttcaatgacttgcttgaggttactgagctagaacactgggagctggtgtataaacccatgctctctggatttgaacctagccagtcccatgccagaatttgtaccataaaccaatatgccatgtcatttctctcatgaatgaatgtatatcatccttgtaagctctacttttaatggctcagaaggaagattttctttgaaattgaaacttgtttaaaccactcttttatttaagtatgttt

SEQ ID NO: 70384 - DNA, 458 bp, Homo sapiens
tttttggaaatagaaaaaacatttaagagatagattgtatatttaattgtctataactgatacttcttggtcttcagtccactttcagaaagaatgttcatatgctgtgtgtgctctataattttgttactttatttttattttaataattcagaaggcagggccgggtgcagtttagttgctcacgcctgtaatcccagcactttgggaggctgaggtgggcagatcacttgaggccagaaattcaagaccagcctggccaacatggcaaaaccctgtctcaaataaaaatacaaaaattagctggacatggtggcgtgtgcctgtagtcccagctacttgggaggctgaggcaggagaatcacttgaacccaggaggcggaggttgcagtgagctgacatcacaccactgcacttcagtctgggtgacagagtgagattctgtcttaaaaaaaaaa

SEQ ID NO: 70385 - DNA, 193 bp, Homo sapiens
gctgccccaggtcagaattcttcattgttcctccatgggtttcaccatcagcctcagtaacctccctgcctcctttttctctcccctccagaacaaccagagtcacctacttgggtacagactgggttcggtccttcccttccagatcttccctagcacttccagtcaagtccagacaccttggcagggcctt

SEQ ID NO: 70386 - DNA, 818 bp, Homo sapiens
gcaattaacaaaaggacccagatggcttattgcctaattgggtgaacaaagcaagaatatggtgtttcttgcttccttaaccagctccatgatttattactttattgcagaagtggctgtcaactcagtccctggctggtatttacagacccttaatttaagtaaaacagatgcctccatttagttctagaaggaccttctcctttagtgtaaccaagtgttcaaattcccttcttctctatgaactcagcattcattttatccataatgatcaatttaaaagtagagaaacttgtcagttgagagatctgattcccaagagattggtttcacttgtctacctgaattttgtgattggattttgttgttcgttttttaagattgaattttgttaccacccccaccaagttcatcatcattattaactataccactggggagaacagagagaagtgtccggccagcagtctagagtcccacactcttcatgctgtattacaacagtaagagcagatatccttcctggagagtgcctgacctgtttcctctttggttttaatgccatagatcccactggaaaattcagaattccaactaacaaagacatggtggttgaaaagtcctcagtgacaataatgatggcaccactgcagcagaacttgacattttagaggtcatgttattgtgcttaatgtgagggggttctattctctactgaaaggctatgaaaaagccagttggacaccaagtgatctgtgaccagtcaccaaatttggacaaacaaaatgcaaacaagttgcatttttaaaaagcattca

SEQ ID NO: 70387 - DNA, 420 bp, Homo sapiens
tttggttccacaggaaggctgcctttattcagtttggttgttaatacctcaggcctacaaattcatctttccaccaattgcagatcctaaaggaaggtttaaaaaggtgaaggaaaaagcatgagcttcagttccttattgcaggcccctctcactgctagactctggtgggtatttaggagatgcatgggagaaacagaaaggaaaattcttgactccagtcagagctaaggtccctttgttttctgctctgagctgtctggagattaattaataagagaaaagaagacgaggatgatggcaacaatgatgggagccttagtctagggctttctctgaggctgctcattctggtgttttgtttggcaggggaagtggtttaaatatttaaattcattcaattattctcttgtcttccag

SEQ ID NO: 70388 - DNA, 441 bp, Homo sapiens
gttagggcatggaaggtcttatttaagatattatctaaggaaaaattacaatttaaatcttcatcagtttgcaacattctaccaaataaaccaaagaaagtatgttctaaatgagtgggccatgagatgaaaagttttggtgggagagtagatgtcatatggagcaaaatagtgtaaagagaagactccaataatcctgtattaagtcccatttttttatgattactagcctgtggcctcaagaaaatgtattcattgagctatgtgtaaaatgactataatagtacctaccttctaggattattgtgaacattagaaattattcatatgatgtgcttcacacaaaataaaaacacaatatgtggtgaggggaacagtagtggttgctgccggtggtgatggtggtagtagtagtagtagtagtagtagtgaagcattact

SEQ ID NO: 70389 - DNA, 658 bp, Homo sapiens
atgcagtgggacaagcaaccccgtgggccagagctcccctgcctcctgccccctcgtcccctgcctcctgccccctcgtcccctgcctcctgccccctcgtcacctgccttcaacttcgcagagtgaagggcctggcgcaaggacccattccatggggttatgtatgtgacatgttctccagcgagggtttaagggataactttttacttcagttgagatgtgccatccttactgaagaactgttacgttctgtatcttttgatctgaaaaaaccaaacagtaaatatagaagtatttgttgacaagaaataagggaaaatgtttttattgccaagagcctttccccctggttcactgaaatgtttgcttgtatacatcactcctggcttagtagagccaacaagacggcaggtcaaacagaagacaacatgaacgtctaacctcaggcaccagtggacacgtgtgggacccaggcagcttcttcaggattcgggtgtcaggaaaaggcgcccgaaatgctggtagaccaggtggctggggtggcatggatggggcttatggacctgggtctttcagaagtgacccatagctcactcctggaaggcgtgagtcaagcaggtggttctgcgcactaacgacgctcttccactgtttccc

SEQ ID NO: 70390 - DNA, 320 bp, Homo sapiens
gcgcacgtcagcacatgctcagcgcacagcacacactcggcacacggtcatcacacgtcagcttgtgcccagcgcacagtcagcacacactcagcacacggtcagcgcacatcagcacgtgctcagcgcacagtcagcacacagcacacactcggtcagcgcacgtcagcatgtgctcagcgcacagtcagcacacacggcacatacgtgcttagtgcacatcagcacatgctcagcacacacttggcacactcgtttagcacactacacatgctcagcacacggtcagtgcacgtcagcactgtgtgctcgccggggta

SEQ ID NO: 70391 - DNA, 2166 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70392 - DNA, 2293 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagagccaacaagacggcaggtcaaacagaagacaacatgaacgtctaacctcaggcaccagtggacacgtgtgggacccaggcagcttcttcaggattcgggtgtcaggaaaaggcgcccgaaatgctgggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70393 - DNA, 2133 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70394 - DNA, 1823 bp, Homo sapiens
atgcagtgggacaagcaaccccgtgggccagagctcccctgcctcctgccccctcgtcccctgcctcctgccccctcgtcccctgcctcctgccccctcgtcacctgccttcaacttcgcagagtgaagggcctggcgcaaggacccattccatggggttatgtatgtgacatgttctccagcgagggtttaagggataactttttacttcagttgagatgtgccatccttactgaagaactgttacgttctgtatcttttgatctgaaaaaaccaaacagtaaatatagaagtatttgttgacaagaaataagggaaaatgtttttattgccaagagcctttccccctggttcactgaaatgtttgcttgtatacatcactcctggcttagtagagccaacaagacggcaggtcaaacagaagacaacatgaacgtctaacctcaggcaccagtggacacgtgtgggacccaggcagcttcttcaggattcgggtgtcaggaaaaggcgcccgaaatgctgggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70395 - DNA, 1483 bp, Homo sapiens
ctgtctccacctccccggtagctgggattacaggtgtccaccaccacgcccggctaatgttttgttgtcttttttgtagagatgaggttttcctatgttggccaggatggtctcgaactcctgacttcaagtgatccgtctgccttggcctcccaaaagtgctgggattataggcatgagccactgcgcccggcctgcaatctataatgctttggttttgttttttccattaaaagaagaatgaattatgcccggtatgcaggtcaaacaattctgcagtcaagaaaacctgagatttggagctgggcccctgtaaatgcacagtgatgtttccgtggcaagcttagaccgtctggtggcctggccagggtctgtggctgtggccatgagggcccagggacttcttggtcagctcttacctttttctctgtttcctgccaacagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70396 - DNA, 546 bp, Homo sapiens
attgatgggcaaagtttgttccatctctaaaactagattgatttcatctccattcatggaagtttctgaaatagcttctgatggtaaaaatgaaaaacgtgatgatggataaggttttatttcatctcacttttcttgcttcgcaggtgatggaggaaatgatgtcagcatgattcaggcagcagactgtgggattgggattgagggaaaggtaggttcgcccttttatcaacacattagcacacagtcagcacacatcaacacgactcagcacatgctgggccactgtacactcagcacctacttggtcagtgcacgtcagcatgtgcttagcgtacgctcggtcagcaaacactcagcacatgcttggtcaacacacatcagcacgtgctcagcgcacagtcagcacacactcggtacacgctcggtcggcgcacgtcagcacatgctcagcgcacagcacacactcggcacacggtcatcacacgtcagcttgtgcccagcgcacagtcagcacacactcagcacacggtcagcgcacatcag

SEQ ID NO: 70397 - DNA, 1352 bp, Homo sapiens
ctgtctccacctccccggtagctgggattacaggtgtccaccaccacgcccggctaatgttttgttgtcttttttgtagagatgaggttttcctatgttggccaggatggtctcgaactcctgacttcaagtgatccgtctgccttggcctcccaaaagtgctgggattataggcatgagccactgcgcccggcctgcaatctataatgctttggttttgttttttccattaaaagaagaatgaattatgcccggtatgcaggtcaaacaattctgcagtcaagaaaacctgagatttggagctgggcccctgtaaatgcacagtgatgtttccgtggcaagcttagaccgtctggtggcctggccagggtctgtggctgtggccatgagggcccagggacttcttggtcagctcttacctttttctctgtttcctgccaacagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70398 - DNA, 2043 bp, Homo sapiens
tgcaaataatgccctgtttctctgtgcctgtaacttagacaacattttaatttgggattctttttctcccttaatggaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70399 - DNA, 2035 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70400 - DNA, 2068 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaaga

SEQ ID NO: 70401 - DNA, 769 bp, Homo sapiens
gaagccccatcatatccatcccaaaccggtttcgagtaggttaaggttatagggacccttgtcagaacattgatacaaagggctcccaaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcagctgtgtttttctcagtcttctacttcgcatacccgcccttgtatcacgggctctctcataggggtgggatgtcacaccatacaccccgtgtcccgagtgctcctcatgagc

SEQ ID NO: 70402 - DNA, 100 bp, Homo sapiens
taaatatacataaatttagatttgtcagtgacggggaaaaatgatgatgaaacacattttctgttctaggaagctgagtccatcaggttaaacagaggga

SEQ ID NO: 70403 - DNA, 650 bp, Homo sapiens
agaaggagccattaaaaaaaaaaaaaaggttggactcggtggctcatgcctgtaatcccagtgctttgggaggctgaggtgggagaatcatttgagaccaggagttcaagaccagcctgtgcaacatagtgaggccctgactctaaaaggagaaagcgaagaaatacacactcataaatggaaacttactatggaaagtgttctttgccttatcacatattaccatatatatatataacatatatatgttatatatgttatatatgtatgttatatataaatacatatatatgttatatgtacatatatgttatatatgtacgttttatatatatttatatatgtatgttatatataaatatatgttagaaaactagattataaactagattatatatatatatcttggacatctttccatgccagcttgtggagaattccttcattctttttgccagctacagagcatgccaatagaagtactggccacagtgtcctgcttgcccaatgatgactttcaggctttgcactaatgagagagaaaatctgtgaaatgggcttgctggtgcaaagtatacaatcttttctaaaaatttttatcattattattgtttttattttttactgaagagctggggagagaagaaagg

SEQ ID NO: 70404 - DNA, 443 bp, Homo sapiens
aattcggaacgaggaggcaggaggattgcttgagcccaggaggtgaaggctgcagtgaactatgatcgtgccattgcactccagcttgggtgacacagtgaaaccctgcctcttaaaaaaaccaaaagggttaaggagtttgcttgaggtaacatagctagtgtgtgtaatggggttctaacccaagtagtatgactgtagagctctgattgttaaaatggcacagagtagggggagaccacactgtttttttttgagacagagtttcattcttcttgcccaggaggtggaggttgcggtgagtgcagatttcgccactgcactccagcctgggcgacaaagagagactctgtcttaaaaaaaaacaagccaccaccaaaaaaagctacctttatcaatcaagtacagtcatgtgtcacttaatgatggggatatgttctgag

SEQ ID NO: 70405 - DNA, 321 bp, Homo sapiens
aaaagctttggaaagtaaaaacattgaaagtgaaggtattctcattacttttatattcatattaaataactctttccttctcttagaaaatgcagaaaagggctgggcacagtggcttaagcctgtaatcccagcactttgggaggctgaggtgggcggatctcttgagcctaggagtttgagaccagcctaggcaacacaacaaaatcccatctctgcaaaaaatacaataaaatctagctgggtgtggtggtgcatgcctgtggacccaactacttgggaggctgaggtgggaggatcgcttgagcctggaaagttgag

SEQ ID NO: 70406 - DNA, 351 bp, Homo sapiens
  misc_feature (349)..(349): n is a, c, g, or t
aacagccccttgaactgggtagtattgtccacattaactaaggaaaagactgagtgtcagaaaagttaagtaacttatccaagatcacaggttaaaatggtggagccatggctcaaaccctgaccgtcagacaccacacccaacaatgttgtttatcctactggtaagctcttagcttggccctttcacctcccactgctgatgtcttcaacagagagttttttggtgcccagtgttagaatggacccaacaagtgaacaagagctgctataggttctcaagcctgggaatgacgtaataaagtgctcagcacgaggcctaatatagagtgacttagctattgtgatantg

SEQ ID NO: 70407 - DNA, 1171 bp, Homo sapiens
taccatcctctgtcttttcagagggattctaggcatgttcaagaaaatatagtatactgttctgtgttttgttcttttcatgtaacaccatagatagcttggagaaaatgccattatcaatatgaattacttagaaacataaccccgctctcttccctgagctcatatggtacaaatcaagcacttatgtgttgaaagtgctgcatgttaaaactctggggtagcagttccctcatagtttccttgtatcctctccctcccgctggcaccattcccaggcagccaagcaggccggacttttccctggcaaccctctcgcctcaattctggcagccctgtgcgctagagtgaaccaagtgtgggctggggagtcaggtttaatttctagttttttaccatctatgtagcatgttgggcaagtcagtggtctctgggcctcagtttttatatccgtaaatggtaaaaatgttagaagtctacttcacacattttggtgagaatgtcatgaggtgtacaaaatagcagataggatattctataaatttaggtgcgctagagtgaaccaagtgtgggctggggagtcaggtttaatttctagttttttaccatctatgtagcatgttgggcaagtcagtggtctctgggcctcagtttttatatccgtaaatggtaaaaatgttagaagtctacttcacacattttggtgagaatgtcatgaggtgtacaaaatagcagataggatattctataaatttaggtgctatttctcaaatcaccttcacatctgagattttcttaactgttgtaacagtggtgacttccatttcatcactgttcatttcacagcctctcctgctctcataaaaccacagaaattgttctaagaatactgataacttatgaatatttttataggcagcagaaaaggttgatacttttaataaaatctgaccataccagctgggcgtggtggctcacacctgtaatcctagcagtttgggaggccagggcgaaggatcatgagattaggagttcaagaccagcctggccatgtactaaaagtacaaaaattagctggaaatcgctcgaacccagaaggtggagtttgcagtgagccgagatcgtgccactgcactccagcctgggcaacacagcaagactccgtctcaaa

SEQ ID NO: 70408 - DNA, 397 bp, Homo sapiens
ctgatctgacaggaggtgtaggtcaggcagtaatggaagtgatggggaacagctgtaaatacagataaagctttactcactcgcccacccactgctcatctcctgctgtactgcccagttcctaacagacagcagacagctactggtctgtggcccaagggttggggacccctgacatagactaaacaattaacaatgtttatattaaacaacttattccaagtttccattttagactctggaacatctgaaatggtgaatccacaggtagtaaatgggaaggagataacagaaaaattgaaggaagtggaagaagcactgggagggcactggtgaagggtctcgggaaagaattcaaatcttcagactggcacagtggctcacacctgcaatccca

SEQ ID NO: 70409 - DNA, 332 bp, Homo sapiens
ctgtctatcatgttctactgctgtctgtctcactagaataagaaccagtagacatctactgtacatattcagggttcattctcagacataaatcccaatgaaagcttatgcaggcactgttaaaaaaaaatcaaaggtaagataagatacaactaaaggtatgggcaacaaaaagtatagaagtttgagggggaaaaacagaatcagtaggtgagttgagagttagttgattgacaacctctttaaaatttgtgcctttttctttttggttctggttgagctagcccagtggttcttaaccttttgaaggttttggatccctttgagaatca

SEQ ID NO: 70410 - DNA, 821 bp, Homo sapiens
aaaaaaaagacccacccaagaacccaaacttagctaagaaaatatctgagcacatccagaattaaatatcacaagttgttggaccaacaccttcaccatatctacagatgagtccctgacactcacatggagctgattgactctgatttgactcataattctaacagtttctgttttcagcttagtctacggcaacaaaataatagtacaggacccactgcagattggtgtagtaatacaagagatgtgaccagagatgagaagaaagagacccaaaaaaatgatcagaagcagaaatgggagcccagaagtgcagctgaccagaagcatttcagtgtcagatcacacgcagcctcctctgtaatgagatcacagcacgtctcatcagttactggttttcattatggtgacactgaacactcatgaaaagttagcattgaaatatgttggtatctccaatttagaaaggtagtgatgatgggtacagtgtttttacggggaaaaaaagccaaaaaatgcattcatgtttgtctactcttaaaacccagctgtccaagaacgattccccaaggccctgtccatcatttctctttctatccttgaagcgcagtgtctgacacataggatgtgctcattgatgccagatgatgaaacttgaatggctggtttcctagggttctggataactctgttttaccgtggatcctggatgtattccaggatgactttaagaaggcgagaaggggtaagacccctgagagctcagtgtttattctgtttttacacatggttagatgagatgatacccaccctccttcaaa

SEQ ID NO: 70411 - DNA, 1386 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 70412 - DNA, 1608 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcaggtcaaccacataaattggcctctcctggagactgccagaactttctcaaagttgtaacatccagagggagtcaccccacccccaagaccggcaactgagatgtttaaaggaactggctggccctgaaggaaagactgaggccattcatctgctctggagttcatcctcgggatctgagatgcacagcctgaagacatctcatcagccatcagctcccttaagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 70413 - DNA, 2783 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcaggtcaaccacataaattggcctctcctggagactgccagaactttctcaaagttgtaacatccagagggagtcaccccacccccaagaccggcaactgagatgtttaaaggaactggctggccctgaaggaaagactgaggccattcatctgctctggagttcatcctcgggatctgagatgcacagcctgaagacatctcatcagccatcagctcccttaaggtgacctgtagcctcctttgtgccctgggggcatttgggattgtgtagaggctctctctcagaagcatctttctgttattttaatgcggatagaaagctttacattctttgctaataacatctgggttttaatagcgcctccttgccctgcctgtctccggcatctctcttttttccctcttctccatctctagagaagccaccagaaaatggcatcttgcttttgactttctttgtgctgattcttttagagaacttagtgatccactttgcaatgtctcgtctcctaacatttcagcttgtttctcagagggcctgtactttgctttctaccagctctttcatcattttcattttctttaatgaaaaataagcaaaactgtatgatttctaggttgtcttcttctcctaaaggatattcttcttccggcctctcttaatctctcttctcagcaactcccttgatctcttttatcatcaatttattgtcaataaaagtggctttaggaagcctcctgttacctggcagggttccagctttctgacactttcctatgggacccacttgttatgtcatccctgtgtccttctggcactccctcttagctggggagggtcagtccccagggtgagagtcggttgggatggcccattatcaggcctttaggagtttatagtcttgtacttccccttcgaagactgagctttagagacatttggatctaaaggcagccatttgatgctgactctttgggtttgcaaagtagtcatttgaggtttttaaaatgtaatttcctctgtgctctttgcaatcgttcacttttcagtaattcaataatatttacagaggacctactttgtgccatacctggtcgctgttatcctggagcttatagtctaatggcaaagaaagatgagttaatcaagtaatcacaccaaaacactttcaattcagccatgaaactgtacaatttcagccatgaaacaatgtaaaggagaggcacatggggctatgaaatcatacaatgcaaaggactggtgtactctcaggtaagtggttctcaaagtgtggtccctggaccggcatctcaacatctcctgtgaacttgttagaaacacagattctccatcccttaactccagggtttggggggaaggtgtccagcatttgtgttttaacctgtccccaagagactgtgatgcatgctcaagtctgagaacctctgctccaggtgatcaaagaaggcttctctgaagacattaaattttggttgatgaaggaaactagggaatagggtggggtagaagtatttcagacagaaagaatggcatgtgtaaaagccctgtggtctcactcctgtaaatcccagcactttgggaggccgaggcgggtggatcgtgagatcaagagattgacaccatcctggccaacatagtgaaaccccgtctctattaaaaatacaaaaaaaattagctgggcatggtggtgcgctcctgtagtcccagctactcaggaggctaaggctggagaatcgcttgaacccggaagacagaggttgcagtaagccgagatcgtgccactgctctctaggctggtgacagagtgagactctgtctc

SEQ ID NO: 70414 - DNA, 1597 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagtttctgttttcagcttagtctacggcaacaaaataatagtacaggacccactgcagattggtgtagtaatacaagagatgtgaccagagatgagaagaaagagacccaaaaaaatgatcagaagcagaaatgggagcccagaagtgcagctgaccagaagcatttcagtgtcagatcacacgcagcctcctctgtaatgagatcacagcacgtctcatcagttactggttttcattatggtgacactgaacactcatgaaaagttagcattgaaatatgttggtatctccaatttagaaaggtagtgatgatgggtacagtgtttttacggggaaaaaaagccaaaaaatgcattcatgtttgtctactcttaaaacccagctgtccaagaacgattccccaaggccctgtccatcatttctctttctatccttgaagcgcagtgtctgacacataggatgtgctcattgatgccagatgatgaaacttgaatggctggtttcctagggttctggataactctgttttaccgtggatcctggatgtattccaggatgactttaagaaggcgagaaggggtaagacccctgagagctcagtgtttattctgtttttacacatggttagatgagatgatacccaccctccttcaaa

SEQ ID NO: 70415 - DNA, 828 bp, Homo sapiens
gaaaaggcagactcactgacctgtttaatgagtgcagtttctgcacgaaagcccatatccctctcccaggcagccccagaactttgctggggaagggggccaaatctcttctcagtgcctgagggatttctggccttaactgctggtggaattagcaggagttatctataaatccctgaggcatccatcagccgactgagcgaggctgcctttttaaagaagttcactgacctcttgttaacttaactccttgttaggaaatatctaatcagctgtgagctaacacgtcagggcccaggggtctgcagaagccgggctcactgtgggctgggtttccagctgtgtgcagtctggtgtctgagctgtggtgttttcctcttttcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 70416 - DNA, 1006 bp, Homo sapiens
gcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcaggtcaaccacataaattggcctctcctggagactgccagaactttctcaaagttgtaacatccagagggagtcaccccacccccaagaccggcaactgagatgtttaaaggaactggctggccctgaaggaaagactgaggccattcatctgctctggagttcatcctcgggatctgagatgcacagcctgaagacatctcatcagccatcagctcccttaagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 70417 - DNA, 1013 bp, Homo sapiens
gcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaaccttaaaaaaaaaagaaggaaaaaggaaagggagaaaaaggaagagaaaaaaaggggggggccgctaaaaaaacacccgcgaggggacgcattagagcgccccaccatgtgtgagacaagggcgcccaaagggggcgtcacaagagacaagcggcgcgtaaacacgctggagaggaaacacgccggggacaaggggagagacacccctggggggcacagtggacacacccggaa

SEQ ID NO: 70418 - DNA, 1687 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagtttctgttttcagcttagtctacggcaacaaaataatagtacaggacccactgcagattggtgtagtaatacaagagatgtgaccagagatgagaagaaagagacccaaaaaaatgatcagaagcagaaatgggagcccagaagtgcagctgaccagaagcatttcagtgtcagatcacacgcagcctcctctgtaatgagatcacagcacgtctcatcagttactggttttcattatggtgacactgaacactcatgaaaagttagcattgaaatatgttggtatctccaatttagaaagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 70419 - DNA, 1615 bp, Homo sapiens
gacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtctttttggtttttcccttggtttcactaatgcgtgcatgtggccctctgaacgatcactggtttactttctatggatacaatctctcctccattgagaattgattttacaaataaatgtcttcgttcaaccttaaaaaaaaaagaaggaaaaaggaaagggagaaaaaggaagagaaaaaaaggggggggccgctaaaaaaacacccgcgaggggacgcattagagcgccccaccatgtgtgagacaagggcgcccaaagggggcgtcacaagagacaagcggcgcgtaaacacgctggagaggaaacacgccggggacaaggggagagacacccctggggggcacagtggacacacccggaa

SEQ ID NO: 70420 - DNA, 276 bp, Homo sapiens
ctcgaggcccaagaattcggcacgaggggccgcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70421 - DNA, 5078 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggccacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70422 - DNA, 2040 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70423 - DNA, 2037 bp, Homo sapiens
aggtgctggtacgctcggaattatgggattgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70424 - DNA, 2408 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtacagagccctcaatggggccgattttcagttgtgtacacagtgtgtcccctttgatcttgttatcattagcccccatttgatatttgggctagcggagaggcccagaaattctatgtggctgagcagtccctgctggggactcattaaggagtggaggagacagggagcagcctctcctctcatctcccctgggtccccttgggaaatgggagctaggagacaaaggccagttagactgcctgcagggtgactgccctggccactgccaggcgagggctcgggggagggtggcagaggtgcatcagccctgagagatgtgtaaacaagaaatgccaactccaaatcgcaagtggagaatacccagggag

SEQ ID NO: 70425 - DNA, 1748 bp, Homo sapiens
gcgaattcactagtgattagctgtgaggcagtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70426 - DNA, 630 bp, Homo sapiens
ctactactactactaaatttgcggccgcgtcgacgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70427 - DNA, 1153 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtctgggcccagcccacaggtgagacaaggtcctgcctgtctccccatcctctgacacatggct

SEQ ID NO: 70428 - DNA, 601 bp, Homo sapiens
aggtgctggtacgctcggaattatgggattgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70429 - DNA, 2197 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcaggggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70430 - DNA, 2312 bp, Homo sapiens
agcaggctggtactggtcggaagtcgtttggatgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtaaaaaaaaaaaaacaaaaaaacaacagacagaacaaagcacaaagcagaacaaacaaaaagacaaccacaagaaaggggcggggagaagacaagacacgacggggggggagagaaaaggcgacacacagcaaagaccaaacaacaaggccaccacaaagaccaagcaacacaaaaccgcagcgcgacgcgaagaacaacccgcggcggcgcaaaaaaacacagggaaaaagcgagaagaaacaaaacacggcaagacgaaaaggaaacacaca

SEQ ID NO: 70431 - DNA, 1990 bp, Homo sapiens
aggtgctggtacgctcggaattatgggattgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70432 - DNA, 1671 bp, Homo sapiens
aggtgctggtacgctcggaattatgggattgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctgccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgta

SEQ ID NO: 70433 - DNA, 620 bp, Homo sapiens
ctgaaatgtattcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaaaattaaa

SEQ ID NO: 70434 - DNA, 596 bp, Homo sapiens
ctgaaatgtattcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttattaaatacactacatttgtaccttattctgtcgttttttaaattgttcacgcatgaactgagtaaaaacgtactttatagataaccaagtgcaaaactaaaatgtc

SEQ ID NO: 70435 - DNA, 241 bp, Homo sapiens
tccctcgtttcttttctttttcttccatgtcattacggagaagggcactggaggcttactgaagagctttgagaaatagcatagaaggcccagagcattacttgtttccagatgatcaagctaaggctgtaccctggctatgaatagcccagcctcctgtggtgtccaagcctggagagattctgtctcattcactcctggtagactggttaacccggccacaggctccttttgccttcag

SEQ ID NO: 70436 - DNA, 395 bp, Homo sapiens
tgtctattggctcctattgtctttccaatcacctttttcttattatcccacagaagccgtagacatgtcttccaattttcctctctaggttgtatgatgaacatcaaaccaatgacctagtccaacattatggtctcatctttgtggccagcactgggttatgtgcctctccatatatagcatggatatagggattttctaataaaccacaaaggaaagtgtcttcaataggaaatatgtattctcctatcaaaatacatggaaaaggaaaagcgagatgaatcgataaaaacaacagcagctatattcaccaaacttcaaaaagtgttaagataaggtgaaatgtatacagattctcggagtaaaaatatatataaatgttgtaaagttattga

SEQ ID NO: 70437 - DNA, 2499 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70438 - DNA, 861 bp, Homo sapiens
acttggcaaagctggccttacattactgatttacacatgcacctgactccccagctagacagggtgctcctccagggccaggtctaatttacctttgtgtttccccagagtacctgcaatgatgcttggcatggtttatcccacagggccagagagttgctaaagtctatcacatgtcatatttaatatttatcaaatgaatgaataaatgaatgcttgaaaggaaggaggaagggagagtggaatggaccccctgagggaagacaggacaaaacaatctccttcggttctctaggcctcatctaatgcaggcatcagagcaggctggggccttgcagcaaagcaagaagagaggtggggttggcatacttttatcagccctgcacaatgtgttccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgagaactacattctctgtatcccaaggcccacagagtgaggaactattccttagacc

SEQ ID NO: 70439 - DNA, 953 bp, Homo sapiens
aagctggtacgccccggattacgggatcaaagagtcacacagatgactgggctcctgggcctttctccagtaagccacagaggagtcagctgcaaatattctcttctgttctacagacctctctcctcttcctgctcatggaattcctggtggagtctgggtcccaaacccatctgttttggtctagaatttcaaaagtgctctccagagcctcggaagccctggaatctgggaatccaagctagggtcacccagaagacacccacagggtccctacaagaaaattaactgccttggccaaataccagcttcctagatgccttggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccggcggctcccatg

SEQ ID NO: 70440 - DNA, 2457 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70441 - DNA, 2351 bp, Homo sapiens
gggctgtacggcccggaagtcgggatcagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70442 - DNA, 2388 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70443 - DNA, 2430 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70444 - DNA, 2665 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggcccaactcctgggaaacatctctccgctgcatggcccggaaccccactgtccagcagatagagccaatccagtaccccagagaggatctcagccacctgggactgtggcagctactgtccttctgtgctcccgctttctccagggcttcagggatgatggtgcaggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70445 - DNA, 2502 bp, Homo sapiens
  misc_feature (19)..(19): n is a, c, g, or t
ggctggtaccggtcccgangatttaggacaaagagtcacacagatgactgggctcctgggcctttctccagtaagccacagaggagtcagctgcaaatattctcttctgttctacagacctctctcctcttcctgctcatggagtgaaagaaagaaggctagctcaaggagtctagctgctcctccaagtccctcttctatctctgcaggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70446 - DNA, 1502 bp, Homo sapiens
  misc_feature (19)..(19): n is a, c, g, or t
ggctggtaccggtcccgangatttaggaagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtgtttgaccaggtcactcaggagggcgctggacatgacccagcccctgagggccaagcagactatgatcccgtcactccatatgtcacggaagttgagtctgtggttggagagaacaccgtgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaaaaaaaaaaa

SEQ ID NO: 70447 - DNA, 835 bp, Homo sapiens
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccggcggctcccatg

SEQ ID NO: 70448 - DNA, 342 bp, Homo sapiens
ggcactttgccggcagtatcaacactcagcttcatgaatatattttcaatgaatgaagacaggtgactgctcagggggcaggcctgattccacatggagtctgcctctctcctcacaggcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccct

SEQ ID NO: 70449 - DNA, 798 bp, Homo sapiens
ccttattaaataaaaatcactagagttaaatattaagttctttaaggttgtaagttgtttgtattttattatatactctgtacatgtggttgttttagcctaattgttatttgtgaaaattaactgtctttatggtggttccatctagattacattaacattaatgttttaacctgtgaatataatgataacttacttcaaattacctgccaattcaaaggttaaaatattgtaaggtttagaaaatggtagaatattctgaagcactaaaccatagttgttattttatttgtacacatgatatgaacattgagcagttcttgctcacccatctctattattctgacattctttgattcattgaattcattgttcctccccacagaaggtaacagggtaccaccatttatcaccaattaatgtcacattctcagcattctcttccttcataccgataactaaaaggacctgaaaccaaccactcagcttgctttctaaatttactgaatctcattctcacggtccaccagatcatatctacttgataacacatatgctttgtccattatttctttggacactcaaggaacccatttgtgctatatttaaactggtatactgaaaaatttactgataatttaaaactatttttacatgattgctatttaatttttcagtaaaaatggtcattttaatttattaaagtcatttgtcattttatattaaaatgatattgtaggtatttcttctacccaatgtcagattacttgtaaatatataataaaattatttgcatta

SEQ ID NO: 70450 - DNA, 7161 bp, Homo sapiens
  misc_feature (1178)..(1178): n is a, c, g, or t
  misc_feature (3868)..(3868): n is a, c, g, or t
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgangagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacggaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggntgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaaggatctctaaaaaaaaaatgc

SEQ ID NO: 70451 - DNA, 558 bp, Homo sapiens
ggtctctcaagcccaggagcatggactgagcccctcatgactcgcaacaactttctttagaataattcccgcatgagtccttttttatattctttgtgtatattttcaagggtttggttaatttgtcctgcagcagcatcgtccctgattaacatcgtgatattaagccattcactgtgtcctgtaacagtctctaatcgttcataaacacatagtagaaagtgggccccaattacccccaaaattattctctacaatacatgtcagctaacaaatggaactttctggaaattttcttcttgtcacttccaacactgaattgtgatatttggcctttaacaggacattcttgatcatggacaaaacaaattttccagataaactctcgctcttggatcctctaagctcttaaacttcctgagataacactttgcctggtcttacccaaagcagcaaacatgggacgttttgaaaagaaaatccatcacttcattgtctaattatgtataatatgtaaactgaaactggattaaaatttaacgtgcacctgaaaattac

SEQ ID NO: 70452 - DNA, 3899 bp, Homo sapiens
  misc_feature (1178)..(1178): n is a, c, g, or t
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgangagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacggaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtaagatttaatgacaataattctcttttaaaaatccatgcactcagtagttcacaaaaaaaaatgatatgtcatttgcaaagaaaaatgtctgttaaaaaacatggcctgtgcaccccagtgccttgatgtagacatgggattgaatcctcggaatttcagccacttttccacacaacccattctgccttttcccctgacatacctccagcttgttcatatcatatccttcctatctgggatatcctaaagcatgggtgttttctcttcagatatgcatgcatatggaagggaaattttacagttactcaaatttttagaaaatgactgtaaataatcaaaatttaattttt

SEQ ID NO: 70453 - DNA, 1454 bp, Homo sapiens
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaaggaaccagtgagaaaggcgaaggacagagttccaggatctgataaaagcattaagtcagctccttagagacgcagacactcttggcagcgaaggaaaactgtttccatcccacacattgcccagcagggatccaagcttactcaacatttttgggccctgatacaggtcatcaggccagacctcctaggaagctaacaaatatgacaaatatttatcttcagaaacgtcattattagccagtcacctgaatttgccttttgcttttcccaactgaggtttttgtcttgtgatattaggcatataaatgacaaaaacacggtgaattttataaggcagggctaggaagtaatgcttacatcacgagtgaacgtggctcatgtgggtctttcctgcacatgggtcacctgtgttttctgcgcccattgttagatggctgcacacgtggctcagcccattcagctgctccgag

SEQ ID NO: 70454 - DNA, 1318 bp, Homo sapiens
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaaggaggctgttctggagctaaagtcaagggcttgcttcctgatgtatgcacgcctcatttggagtctgccaacagcctaggggctgtattattcatgccttgacagagagcactcactaaaagccctggaacagagccaggtgctggctgagagatgtggagcattgcaacttgcaactgagaggagcatctataatccaaaaataaataaaaaaagaagaaacagagaggaagacagagagaaaaataggagttcctatatctcccctttaccagtttcacatagatagaaatttcatttgcattaaaataaaatatcctaaaaataattgcat

SEQ ID NO: 70455 - DNA, 662 bp, Homo sapiens
aagaaaggagccggaaagttttgttttgttttcgtttgccgtgttgtttgtttctttacgcgtaagccccagcaccctgaggcccgtcccacgcggctgtgtgtggctgaggccggggcgggcaggccctgccgtgtgctgtctgccgtgtgccctgcggccggggcctgagtcatccctgtccctgtctccccagcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcgggtacgcgcgcctgggcaggtggagccacctggcgggtgggggaggccgggccgcggacccagccaccgagacacgcggcgctttcggggcagctgtatggggcaaacgccgtgatctcctaaaccattctcgccactgtgaacaattagtgcagcttcccttaacgcagcctgaacacaccattgtccaaagcgcatccattttctaaatcaga

SEQ ID NO: 70456 - DNA, 7003 bp, Homo sapiens
  misc_feature (1178)..(1178): n is a, c, g, or t
  misc_feature (3710)..(3710): n is a, c, g, or t
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgangagaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggntgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaaggatctctaaaaaaaaaatgc

SEQ ID NO: 70457 - DNA, 3722 bp, Homo sapiens
  misc_feature (1178)..(1178): n is a, c, g, or t
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgangagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacggaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaagcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagacattcttgatcatggacaaaacaaattttccagataaactctcgctcttggatcctctaagctcttaaacttcctgagataacactttgcctggtcttacccaaagcagcaaacatgggacgttttgaaaagaaaatccatcacttcattgtctaattatgtataatatgtaaactgaaactggattaaaatttaacgtgcacctgaaaattac

SEQ ID NO: 70458 - DNA, 3858 bp, Homo sapiens
  misc_feature (1178)..(1178): n is a, c, g, or t
tttccctaagctactgcacactaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgangagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacggaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcgggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagatccctgtccaaggccctagggccctagatcacctgcttatgttcagtgacttcctgaactagctctttcgccacaagacccttggaactttcttcatggaatgtaaacgcctggagggcttcctcttacctaacggctgtaaagtctgtagcctcatccaaaacagtgcctcatggaaaagtagatttaggatctcaaaacggacagcattagcaagagcagttcaacccactttgttcaggcgtcttttgtatggctcgaaaccacatttccctcatggtcaaaacatgactaactccacttggaactt

SEQ ID NO: 70459 - DNA, 1436 bp, Homo sapiens
  misc_feature (1)..(1): n is a, c, g, or t
  misc_feature (5)..(5): n is a, c, g, or t
  misc_feature (9)..(10): n is a, c, g, or t
  misc_feature (13)..(15): n is a, c, g, or t
naagngtcnntcnnnagatgaataaatttcagttttgtacaatgagaaaagtttgggagattggttacaaatggtgtgaatgtacctaatgcactgaacccatacactttaaaatggttcagatgctaagcttttttgtgtgtgtatgagataaattcttgctctgtcacccatgctagtgtgcaatggtgtgattgtggctcactgcagcctcaacctcctgggctccagtgatcctcccacttcagccttctgagcagctaggactacaggtgcatgccaccacgcccagctaatttttgtatgttttttgtagagatgggatttgggatttctttctttctttttctttttttttttttgagatggattttcactcttgttgcccaggctgaagtgcaatggtgtgaccttggctcattgcaacctccatctcccgggttcaagcgattttcctgcctcagcctcccgagtagctgagattacaggcacccaccaccacgcccagctaattttttgtatttttagtagagacacggtttcgccatgttggccaggctggtcttgaattcccgtcctcaggcgatccacccgccttggcctcccaaagtgctgagattacaggcatgagccactgcacctggccaaaactaagtctttaggaaaatgtaactatgattaaatagtgtaatctgtataaactttaggaggatatttggcaatacatgtcaaaactcttattgtagaagaatgtctaatgacagagtaatgtatatatgatacattattaattgcaaaaagtctatttataaacgtaatggtgcaagcttatgtgtgcccatgcatgtatgaacagacagaagatacacactgaaatgttacggttccacgttctctaaagcaggcattcttgacaggtacaatacatctcccaattgggtaaaactggatcttggcacaggagggagtgtggaaaaaagactttgacattattaatataatagtctgtggccctccaaagcgtcacagtacataaacagatatacagcatatatgtagtactgaaatttttagggtgggaaaaagtgattaggagaaaatgtctaaaaaggctaattaggggtcaataattttaaaaaggttgaaaaacatagggcatgatgccaaaaaataaggcaaagttccccagtgtgaggaatgaatgaatgaatgaatgaataaataaataaataaataaataaataaataaatggtatgggtttcatatgtgctgagtactgattctctcaggcctttgaggatgccaatcaaggccagtagcaggggtagggttagggccctggggtatttgtccttggtctgcagcatcctcttctatttattccattgtgcctccaaatatcatttgctgtgagtgctgttatgtgagaaaggtt

SEQ ID NO: 70460 - DNA, 307 bp, Homo sapiens
gtgccactgcattccagcctgggcaatagagtgagactccatctcaaaaagaaaaacaagaaaacccaaaaaaaccactaacaacaaaacccagcctttttgctgatatggagaaagctttagtgatctggagagaagatcaaagaagccgcagcacttccttaagccaaagcctaatccagagcaaggcccctcttcagttctctgaagcccaagagaggtgaggaagctgaagaagaaaagtttgaagctagcagaggttgacttacaaggtttgaggaaagaagccatctctctaacatcaaag

SEQ ID NO: 70461 - DNA, 724 bp, Homo sapiens
agcgggggaacagcatcagtgggcttttgctttatctaggctagatgaagaccttggctgtagatgagctgtccgtgacgtaggtttgtacgtcaactcagccttattctgggaaatcattaatccttaactctgatgactgtgcaaaagtagtcactgaccactcacgcagatgcttgagagtgatcacattcttgtagtgataaaaggttgttttaaatcatgagccatttttcccatgactcttgtagccccttgagcttgaaacttggggtaacactagcttgctcttcttaccagcttgagctcagctgaatatgacggtgaactgagatccctgcaccagcttgtcagcatgtgatgggagagaatgctctggacagggtatgcatgccatcctaaaataaaacataaatccttgacaatttcctttggacagtcaaaccatttaaggaactaggaagatcttggctgactaagagactaatggtcctttgtcctgtcccagtcacagcttttctgttttctttggtgctgcactgaagttttcttctatttgtaaaaaggcagagttatcatcccttttcctaactttctttttcagtctcttggccctcggatgtcattgaatgtctcaccttgcatcattaagcatacttgtaatgtggtcttttcttcatgccatacatgttgtatcttcttatcatttctctgatgctatgag

SEQ ID NO: 70462 - DNA, 812 bp, Homo sapiens
  misc_feature (13)..(13): n is a, c, g, or t
  misc_feature (90)..(90): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (120)..(120): n is a, c, g, or t
  misc_feature (123)..(123): n is a, c, g, or t
  misc_feature (125)..(126): n is a, c, g, or t
  misc_feature (133)..(133): n is a, c, g, or t
  misc_feature (673)..(673): n is a, c, g, or t
  misc_feature (690)..(690): n is a, c, g, or t
  misc_feature (698)..(698): n is a, c, g, or t
  misc_feature (704)..(704): n is a, c, g, or t
  misc_feature (711)..(711): n is a, c, g, or t
  misc_feature (715)..(715): n is a, c, g, or t
  misc_feature (719)..(719): n is a, c, g, or t
  misc_feature (769)..(769): n is a, c, g, or t
tcaaaattttttntttaactccatcacccataactttacatttccattcacccccttaaattcactcctctctttcccaaacacatcttntacattttaacntantanancaccccaaanttnannccaaacnattctttttctttttttaattttacatgcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagagctgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacagtnccgtgtgtgttgctttnaagtggtnaagttnacgaggnattnattnctgagtgaggctaatgagtgtcgtattggctgtcttctcttctaattctnctatgtttttttcatttctctcttgtttccttttctatttctc

SEQ ID NO: 70463 - DNA, 5813 bp, Homo sapiens
ctcctcccctccccctccgccctcctccgctccgggccagcgcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactcacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagagctgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaaaaaaaa

SEQ ID NO: 70464 - DNA, 4574 bp, Homo sapiens
ctcctcccctccccctccgccctcctccgctccgggccagcgcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactcacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagta

SEQ ID NO: 70465 - DNA, 5730 bp, Homo sapiens
ctcggagagtaggggggacagcggatcccagcaggttaggccggaggaacagcgccatgtgctccgggctcctggagctcctgctgcccatctggctctcctggaccctggggacccgaggctctgagccccgcagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactcacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagagctgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaaaaaaaa

SEQ ID NO: 70466 - DNA, 1307 bp, Homo sapiens
ctcctcccctccccctccgccctcctccgctccgggccagcgcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcaggtactatggccctggcctggaggaggtctggcacagctgagaacactgaagttaaattccccatggtggaaggtttgcagagagctggggttgttcctgctgttcctgcttgtaaagtactgctgaggaaggtcctgcccagcagagattgctttcctactgattatgtgcttgaaatactggttggactggctgtatcactgagaccttcagactgaatttctctcacccctggacactgagattggctctcaccttgtctatccagcagtagcctacactgcttgagctcagctgaatatgacggtgaactgagatccctgcaccagcttgtcagcatgtgatgggagagaatgctctggacagggtatgcatgccatcctaaaataaaacataaatccttgacaatttcctttggacagtcaaaccatttaaggaactaggaagatcttggctgactaagagactaatggtcctttgtcctgtcccagtcacagcttttctgttttctttggtgctgcactgaagttttcttctatttgtaaaaaggcagagttatcatcccttttcctaactttctttttcagtctcttggccctcggatgtcattgaatgtctcaccttgcatcattaagcatacttgtaatgtggtcttttcttcatgccatacatgttgtatcttcttatcatttctctgatgctatgag

SEQ ID NO: 70467 - DNA, 312 bp, Homo sapiens
ttttaaattcatctctgtgtggtgtctgggtcagctctgaagttacacttcgcaaatagaactctggtcagagcacccattctccccagcctctcgacttttcagtaccaacctggtacaaataaaatggcagcagtaacatgagaatattggaaagttagttctttgatgacacttcccctagacaagcacattaagcaaatctactcaaaacatagcagagccgcaacctccatgttaatgatagtttatttagccgtgcatttatacgaaatggtgatgtttgctgtctccctgcttctctcttggcag

SEQ ID NO: 70468 - DNA, 734 bp, Homo sapiens
ttccctcgagctatgggaagcaccctcgctaaggcaaagcatacacactcagatgcccagagtccaaacaagtagctgaccccttttgctgagaccttgaagagggccacctcaggcacatcaagagagatcaaaccacctcaatacaagggcaagcttctttagcccattgtggccagggcagaattcaggtcctactgccagatttactggtttcccaagtgctataaatccagtttaagtgaaaggtgtctgagggggtgcatttggacccaccggggcctggggcataattcgaaaaagcatgtgcattcttatgatttcatttcatatttggaaaactaaagaggaaatatttttcaagacactatagaatggtaacatttaacaaaatcttggctcaaagtggtctgtttaaaaagtctaaaacacttattttcctattatggtaaacaaaaatgtttgtatcactaaaaaacaccttcacaatattttaatgactctttcctgatgttgttgttatttagcatagcagtctcttctagaccttagtcgttccttcattcatccaataaactattaatagtgaaggctatttgccaagccctgagaacatggtggtgaccagactgacacagaccctgccctcaagagactcatattccagctagggaggcagaaactatttttgcttttttacctatgtcatatgaagaacattttttcaaatcact

SEQ ID NO: 70469 - DNA, 527 bp, Homo sapiens
tcccaaatggttacgtatttcttttacaaaatatgctgatgtctttttttttttacaggttgaaaaaagaatagcttaggagtagcacatagagagttcttgtgtgtggcctttgtttctcttgacttttataaaataggatgtttcttgaaagctgggtgctgttaaataatgcatggttttcaactggttagatggtacagcagaacactgggggtgaagaaacaaggatttcagtactaattcagccaacaactatccctgtaatagtgagcaagtaatctgtataatcctgcatttgctattctatttcatacaaataaagctataagttagaacttacacttgtagtgtttatgacactccaaaaatagcttgtggtgttcatgacaatttaggatttaacacaatgttcaaatttgataaaaatatgagaaagctatacgatacaaacatgcttaaaagctatttgccatttttaattttaacatatttaaaaaataaaatttaaagacatctggatttct

SEQ ID NO: 70470 - DNA, 1566 bp, Homo sapiens
tggaaagccattttgcttgggttgacactgattttagaaattcaaacaatttgtgctgaagagcaaggtctttggagaacatttgggatgataactagtctcccactccaaactggatgaatgacttgataaagtcattttaccccttcgtttgtttgtttgttcgtttgtttgtttgtttgtttagacagagtcttgctggagtgcagtgagccgagatcatgccactgcactctggcctgggtgtcagagcaagactccgtctcaaaaaaaaaaaaaaagattaaatgaatcataagaatggggccttaatctgatagaattgtggccttttaagaagaggaagaaagagaaaaagagaaacatctgtctctttctctctcttaaccgtgtgaggacgcagggagaacgtggccatctgcaaatcaaggagagagtcctcatcagacattgaccctgctgtcaccttgatcttggacttccagtgcccagaactgtgagaaaagaagtgtctgttgtttcagccactcagttgatggtgttttattatggcagcataaacagactactgtaggagcttagactctgggtcctgatacatatcggatcctgatgcttatcaaatccaggctccttccttgaatgtgtgacctttggccaggttctcgacttctctatgcctcagtttactcctcagtaaaatggagataataatattacttatcacctcagtaaaatggagacaataatattacttaccatctaggtttattttgagacttaaataacttaatgtatgtaaagtatttatattgtgagtgcaaaataaattaactattataatagtccctaatgtacttaatatctaactgcaaacattgccaagttttcttcttgtccaaagtcacaacagttttctttaggaaattttccatacaaagtggggcacattttcactgggttctttaagatgagataataaaaaatgatacgttagaaaattttccttatggcatcagtcttctctgacagattgcagcttcataaaggcaaaaactcttgattttctttttaacccacataagcccttaataaaatacccattacatgtagttgaagtaagaaaagctggaagtgaggaatggaggaaagaagaaaagaggggcacaaaatatttcattaaatgttttaaaaatccccagaaattcagaatacatgaatataggctgacattaaagcagatgtacgtctcgtgcagaacacacagtgaggaaacaaaatggcaagagcaaagctaaagaaaactaccaaatttgcattttcattaattcagccttaaatgtaactttgtgtcactgaataagtgacttacttcctaaacatgacggtcagacaggaaatcacttttcttgtgattagcataatgcttatattgtttttttagctacagtctaatcattacaaagaactactcgttgtgtccatattaaaattaaaagtaccttgccataacaaaagcacattctaagcctttcgaaatgtcaacatattaaaatatattaaagc

SEQ ID NO: 70471 - DNA, 487 bp, Homo sapiens
gaaaagacagttcttagaaaaaggcaaagggctcttagccatatgaaaggataataatcggcctcactgataagaaaaacgtaaggtgaaactacaatagattatgataccctaccaatcatactggcaaaaatccaaaagtttgacaacatattctgtttgtgaggctgcaagcaaacaggcattctcatacatttttggtgggaatataaaatggtacaaagaggaagaggagtttggcagtatctaacaaaatcatacatgcatttattctttgacataatagtctcacaccgaggagtctttcccaaaggtagactgacaagaatatagtacatggagtgattcactgcagcactctttgaagtagaaaaagactgaaaacaactcaaatgtccattaatagggggctcactgaacagattgtggtatatccacaggatgcggtactatgtagctgttacatgaatggggaaatagctctttg

SEQ ID NO: 70472 - DNA, 1408 bp, Homo sapiens
  misc_feature (162)..(162): n is a, c, g, or t
  misc_feature (217)..(217): n is a, c, g, or t
  misc_feature (801)..(801): n is a, c, g, or t
  misc_feature (1332)..(1332): n is a, c, g, or t
ctctgattcatgaaatgtgaatttatgacagttgccactcttaaaaaaaaaaacaaacagacagaacttgagcaatacatgactgatgcattctcagcctgcttcctgtgttccatctgtctttctgccagtgcattcaccctccaggtttgaaagtagtcnggcaagaaagtactaaacatagagaaagggcaattccaaaagaacaaatgattgnttaatttaggctgacattacccagttgctgggggtatgggccatggggatgggccatgttcaccacttaggttgggcaaattcccaagatgccttttgacatagtaatgagggggaatacatcactcatgcccactggcattctctggggaaatttttaaaaggcagtatatcccactccagttgagttcaaatcaggtgccatatctacttaaaaatagcctcagatagaatggcaactcaaatgacagtttaactttcactactttctcggtagtgaaactttctacattccacattttctatcaagaaaagaaagaggttgtattgtgaggtaagaggcacacacacggacttccttcagtagctgcaatccttgctataggtcaggcatcaagacaattccactttacaggcctggattttggagaaagaaaggtgtttacaagtttctgtataattatagttatactgacatttaaatagttcaacagactggacttcctaacattcctattacatcgatattaatgaaagcatgacacaggtttcaaggaagcatgtccaggtatatgctgaatgacntaataagaaaaatgtaaatatgcattgcttttgtcttaaggtaatacttgtgattgcagaatcctagaatgtagagatgatggggacttcagagattctttaatccaaaccctttatttaatggaagaagggaaaaaggtctagagaagctgtgacttctctcagatcacacaataaattagttgctgaggtagaacaaaaacctaacttccactttaccatttccttgagaaactgtagaacaattgtaagccactgatatattccacataataaagccgctctgttgcctttttaggttctagtatgttacgtttatgttcccctgctttctacaatcctgttcaaagagttgctgacttaaccacagagaggattccagaacctgagacacagaataaacttgagcaatcatagtccatccacttcattgtctcatcaaaaaccaaaggtccagtgaagctctggaactcaacgctgtaaaggagcgaaggagcttctatacagagcctggatgcctgtctccttatnctacttcagtggacttgactgcaatccggattatgctgttttctaagcatttaaaataaaataaaaagtataaaag

SEQ ID NO: 70473 - DNA, 361 bp, Homo sapiens
  misc_feature (285)..(285): n is a, c, g, or t
ccttgctaccgacgatatcttcggtcctatctttcttgcgcaatgcacattggttctagtatgttacgtttatgttcccctgctttctacaatcctgttcaaagagttgctgacttaaccacagagaggattccagaacctgagacacagaataaacttgagcaatcatagtccatccacttcattgtctcatcaaaaaccaaaggtccagtgaagctctggaactcaacgctgtaaaggagcgaaggagcttctatacagagcctggatgcctgtctccttatnctacttcagtggacttgactgcaatccggattatgctgttttctaagcatttaaaataaaataaaaagtataaaag

SEQ ID NO: 70474 - DNA, 649 bp, Homo sapiens
  misc_feature (573)..(573): n is a, c, g, or t
ggagactctaagacttctgaagagtttcttgcttctttcctgtggggcagtgactccacttcccagcagtaatggaatatcctgaattagctacattaatgttagaaccatttggacctcacccaggacttcaactacattatgctaaagttacagaacccaaatttggcaactgtctgcatctgaacaacagaagtttcaacattctgccaacagagtaactcctggacgattggcacagaagaaggcacaaggcaaatacccatctctgtacaccctgtgctactgtgtcatgtgctgctccaggcaactccaatggattggccaccctggccaatgtgttctagtatgttacgtttatgttcccctgctttctacaatcctgttcaaagagttgctgacttaaccacagagaggattccagaacctgagacacagaataaacttgagcaatcatagtccatccacttcattgtctcatcaaaaaccaaaggtccagtgaagctctggaactcaacgctgtaaaggagcgaaggagcttctatacagagcctggatgcctgtctccttatnctacttcagtggacttgactgcaatccggattatgctgttttctaagcatttaaaataaaataaaaagtataaaag

SEQ ID NO: 70475 - DNA, 329 bp, Homo sapiens
tgagacagggtttcactctgtcacccaggctggagagcagtggtgagatttctgctcactgcaacctccacctcccaggttcaagtgatcttctgcctcagcctcctgagtagctgagactacaggtacgtaccaccatgcccagccaatttttgtattttttgatagagatggggtttcaccatgttggccaggctggtcttgaactcctgacctcaagttatccacctgccttggcctcccaaagtgcttggattacaggtgtgagccacgaggctggcaccaatgccatcttgatcaaagaaaacaaagttggaggcattatacca

SEQ ID NO: 70476 - DNA, 322 bp, Homo sapiens
aaataaagatcagtaagaaaggttctgtcttcaatggttcgcagcaacgtggttgaaaaaccttggcaagagtacatgaactaaataatattaaccacacacaggttgtgatctgattgtaggtattaggcagagtatcagaacagaatgcatttctgtaatcctcatgttaaagaaaatggattcttttctttttataagactaatgatgactaatataagactaataagaataaaccaacttttattgttctgtttcctataccttattgtaaaattaatatttattgagcacttagtaggggtcaggcattcactgttc

SEQ ID NO: 70477 - DNA, 402 bp, Homo sapiens
agtctgtggtattcttgttaaggcagcccaagctgactaagacaccaaatcattcaaaacgttaattctttttctgttctttaagcttcccagaatgtacacaaacaatgctgttattaaaatttaaaggactcttggaactgtaggacatgatccagctaaaataaataacaaataacacagctaagcaaatacttataaatgtagctttaaatatttattttagtcagttttaaataattagtggggtacgagacagttcacattcaagagacattttacttagacaaaaatttataagagaacgatgcataaaaacaaacaatatattggtctgtttatttttctaagggaaaatggaattggagctgttgagaataaaacttgaagaatctaactgca

SEQ ID NO: 70478 - DNA, 189 bp, Homo sapiens
gaactgcagaggttcacagaaagtggcacatggtaagcactcagaaagtgcttgctgcactaaagggaacgatgttgaataataatcactggtacgtgaataaaccccacatgtgctggacatacacagagtcccatattaatgagggcacactctcagatgcatctggcccgcaggaaacctgactaa

SEQ ID NO: 70479 - DNA, 372 bp, Homo sapiens
gggcatggtggtgcgcacctgtaatcccagctactcaggcggctgagtcaggagaatcgttcgaatacgggaggcagaggttgcagtgaactgagatcatgccactgcactctagccactgcacgctggtgacagagtgagactgtctcaaaaaaaaaaaaaaatttttttttggtacgcttgagggagacaaatgctacaaaagcgttataaactgaagttctatggaagctcacttgaagatattgaccaagtttattttatctcctattcattttcctccctcctgtattttaagcaaattccacataacatttttttcataagtatttcagtatttgcttttcaaagacaaggattaaaaaaaaactg

SEQ ID NO: 70480 - DNA, 229 bp, Homo sapiens
ggagtggttctcagatcacaaactgacatggttttatctagaagagacacatggctctgactcactgaatttccatgcaggatctaactgggacacatcaagggaacttcagtgttttcagcaccagcttcacaagaggagaatgagacacagtttttatctatttcctctggaggacaaaaggtctggatccagggtagttggtaaaagaagctgaagtgtcaggcag

SEQ ID NO: 70481 - DNA, 356 bp, Homo sapiens
gaggctaatgatattctattgtatgtatatgccacatttaaagaattcattcatttattcattgagggacccctgggttacttccgccttttggctattgcaaataatgctgccgtgaaaacaggtgtacaaatatttgtttgagatcctgctctcacttttgggtatagacccagaagtggaattgctggatcacatggtgattctgtgcttaagttttttgagacaatcctagacttttgcacctgattctttgtctctcctggcctctgaggacttgactgcccagctagcattgtactgaatttgctggggctgaggccccagtcatgggcccctggcttcctgagtaccct

SEQ ID NO: 70482 - DNA, 1551 bp, Homo sapiens
agcaggctgtacggtcccgagtctttaggatcctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgctaactctttaggtccgtgccatctttaagcgctgtaacactcaccacgaaggtccctggctccattcttaaagtcagcgagaccacaaacccacaggaaggaaccaactctggacacggtagcagcattcagaaagcgcccttccccaactctctcttgccttgacggtaaaatggatgcact

SEQ ID NO: 70483 - DNA, 326 bp, Homo sapiens
  misc_feature (306)..(306): n is a, c, g, or t
ggatccggttgcagtgagccgagatcacaccactacactccagcctgggcgacagagtgagagtctgcctcagacaaaaaaaaaaaaggaaaaagaaactagtccctcaacctcctacagggcctctgtgtcacacagacatcactccgtctggtgagtagccaccccatccactctccttttgttgctgacaccccttttccaattactcagattttattttggtgcccaatcccatcccagatatccttattttcctccctccctccattccttccttcttttctcattccccttagtgggggngggggggggggggggaattc

SEQ ID NO: 70484 - DNA, 281 bp, Homo sapiens
  misc_feature (261)..(261): n is a, c, g, or t
ggatccggttgcagtgagccgagatcacaccactacactccagcctgggcgacagagtgagagtctgcctcagacaaaaaaaaaaaaggaaaaagaaactagtccctcaacctcctacagggcctctgtgtcacacagacatcactccgtctggtgagtagccaccccatccactctccttttgttgctgacaccccttttccaattactcagattttattttggtgcccaatcccatcccagatatccttattttcgggngggggggggggggggaattc

SEQ ID NO: 70485 - DNA, 2052 bp, Homo sapiens
agcggggcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgctaactctttaggtccgtgccatctttaagcgctgtaacactcaccacgaaggtccctggctccattcttaaagtcagcgagaccacaaacccacaggaaggaaccaactctggacacggtagcagcattcagaaagcgcccttccccaactctctcttgccttgacggtaaaatggatgcact

SEQ ID NO: 70486 - DNA, 1073 bp, Homo sapiens
agcggggcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacc

SEQ ID NO: 70487 - DNA, 1040 bp, Homo sapiens
agcggggcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacc

SEQ ID NO: 70488 - DNA, 2019 bp, Homo sapiens
agcggggcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgctaactctttaggtccgtgccatctttaagcgctgtaacactcaccacgaaggtccctggctccattcttaaagtcagcgagaccacaaacccacaggaaggaaccaactctggacacggtagcagcattcagaaagcgcccttccccaactctctcttgccttgacggtaaaatggatgcact

SEQ ID NO: 70489 - DNA, 586 bp, Homo sapiens
ggttggggcttagctgctcggtgaattatttactgaaagattttaataaatggcctgcttaagattttcatgtcagggctgggcatggtggctcatgcctataagtctagcactttgggaggccaaggcagaaggatctacaaaaatttttttaaaaattaccaggtgtggtttcacacacctgtagtcccagctactcagaaggctgaagtgggaggattgcttgagcccaggagttccaggcggcagtgagctacaatcaccactgcactccagcctgggcaacagagtgagactctatctctaaaaaaatttaaaacgattcccatgtctcgcagcaatggtaatgtaggcgcatgataatgctatctggctaaaatactccccagactgcagagcaaagtttctagtagtcaaatactttcctttgcagaacattactcctggatcagcgagacaactcagtgactttattaaggtgtgtagaaaatagtttgtcacctagcttctaatcgaagggtagtaaatatgaaaggggtaaaattagcaattgttctgtagattctctaactgtataacatgtata

SEQ ID NO: 70490 - DNA, 1075 bp, Homo sapiens
  misc_feature (707)..(707): n is a, c, g, or t
  misc_feature (713)..(713): n is a, c, g, or t
  misc_feature (720)..(720): n is a, c, g, or t
  misc_feature (722)..(723): n is a, c, g, or t
  misc_feature (729)..(729): n is a, c, g, or t
  misc_feature (734)..(734): n is a, c, g, or t
  misc_feature (740)..(740): n is a, c, g, or t
  misc_feature (760)..(760): n is a, c, g, or t
  misc_feature (762)..(762): n is a, c, g, or t
  misc_feature (835)..(835): n is a, c, g, or t
  misc_feature (843)..(843): n is a, c, g, or t
  misc_feature (1069)..(1070): n is a, c, g, or t
  misc_feature (1072)..(1072): n is a, c, g, or t
ccttctttaatttttctcaccaattgcttttaggggcctcgtacctgcttcattgcatgtattgttaagcatgtaatgattctggctattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatgcactaacggaactactgccacaaccaagatagaggaaattccctatgcccaaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtcttgtaaatactgagtagtattccttcatgtggctataccatgtatgtttgtactttcacttattattggacatttctatcattccacgtttgggctattatgaagaaactatcatgagcatccatacgtagcaggccaggtctcactaacacaggcctccctaaaaactgtttcagtagcgactgagtggttcaattaaatattaagaggaaaaaaaaaaaaaaaagangccagngcccttntnnaaaggntggantgtaanaaaagcccaccaagagtttngnctaggtttttcctgggccttaaagcatgacgaaataacgaaggcattcttaacaggagccatttagtattaancgagtttnactgggggtctgaagaaactccccaggcctccacagacaagtttattggagatctgaagggactctccaaacctctgtgatttagcaggagacaagataagggcccccagcacctagacccatttagattaagtgaatttaactgaggttccagaggaaggtctttaggactcagacttagttatagattaaaagaagttaatcacttatgtatttagatgaatcnnanttc

SEQ ID NO: 70491 - DNA, 504 bp, Homo sapiens
tggggtttcaccatgttggtcaggctcatctcgaactcctgacctcaggtgatccaccctcctcggcctcccgccaggcccattcttaatgggggaaacactgaaggtgtccaaatgaggaaacactgaaggcctgcaggttaagtcaggagcaagatgaggacattcattatcaccattgtttgggaggtgcaagtcagtgtagtaagtaaggtaaggcaaaaaggattatggatgttgaaaaggaagccatacatttatcaccatttccaggaatagtgatacagtagaggaaaagaacattcctgagaataagatgaaagtttgaagtggaagaaagagaggttgaaacattttctgtttggtgccctctgtgtttttggtgaatgaaggctttttgctgaaagtggaggggatgagggtgaaattgggcaactaagaagaataggaagaaaagttatggagaagccactgtgatgaaaaattatgtggaatagctccaag

SEQ ID NO: 70492 - DNA, 301 bp, Homo sapiens
tttttttactatcatgtgctgaattcaccttagaaattatagttttagattaaaataaagaataaaaatgaagatattattagatataagcagttttaacctatgtagaatgttataggaatacttgaaatgatcaatgatatcaaactgtgataaagcattgtttgaaaccaaaagggacaatagtgttctggtacagagggtggagactaagaaaggtagataatgctcactttttccatggaacataatgggtcctaggagcttttattagcaaagaaacagaggtgtccacatttga

SEQ ID NO: 70493 - DNA, 399 bp, Homo sapiens
ctcgttgacagtatccacagaggccagaaacaactctgcttgttatgataactttggcttcttcatgactgctaaagagttgtcccagcacttggggaggctgaggcaggcagattgccctgagctcagaagtttgagaccagcctgggcaacatggtgaaaccccgtctctacaaaaaatacaaaaaaaaaatttatccagtcatggtggtgcacacctgtagtcccagctacttgggaggctgaggtgggaggattgcttgagcctgggaggtggaggttgcagtgatctgagatcacatcactgcactccaacctgggcaacccccagactttctctttcccacctccaacagtgagaccctgtctcaaaaaaagaaaaaaaaaaggtaactagtc

SEQ ID NO: 70494 - DNA, 454 bp, Homo sapiens
gtgggtggtagctgagtttggttgctgttgctgttttctaaaaagagcccatcaataattttgaggtttacatataatttctcataaagtttacctggtttaaatatgatttataggaggataaatatgattgattaccaaaaatctgtaataaaaaataaccaactgagatacacaaagttctttaaattcttcagtgatctgttttatatatttactagacaaaactatttatctcccaacttcacatagaaaaagtactgtgaggaatttattggataagctttaagagtcaagatagaaaatatagaacgtttcttttttttaaccaaatgaaagcatttaagtgtaataattccaagtgtgtgtttttatggattttggagaggataagaaatagtatgtgattgaaattttggaaatgaatgaaactgtagtaatacgtgctgcttgt

SEQ ID NO: 70495 - DNA, 493 bp, Homo sapiens
atcaaacccccaaagatctggaaaccgtgcaacagcggacccagctccctctcttttgtagcagttgtagagcatgtctgtcctatgtgtctggatgttcgagctctccttttagctcgttcatttcccagtgaggaagctgaggccgtaaggtggtaagttctgcttgctggaggctccctgttggagcctctttgcgcacccagcagggtccctgtgcagctgggggaggtgcactggcagagctgcgtctccagtccatgccatctgtgagaagcagctgcctgtaggcttgtgtgggggacagagtaaggtaatgcatgtggaactctgaggatgatgcctggtactcgggagctctccatcagctgtagcctaggccttcacaggcctgcctggctggccacatcccttagagagacgaattgctgttttctaaacgctggaacactcaggaagttctcctctctcccctccaaagggcttatgagaa

SEQ ID NO: 70496 - DNA, 482 bp, Homo sapiens
ccttggcctttgggactaagttctcacggggtttagggtgaggatgtgagagtaactgagctccacctttgcttgagctttaaactcaccctgcggaagagagacattttagccccactcccttcctaccttgaagggtcctgcatgatatgtgatttatcatggcttttctctttctcttctagtcctcatttttttggcagaattctctcagagtccccacatctgggtctcttcccttttggaggctgggatggcggagactgtgagctgcgaggtggctagggtgtttccagccaaagaagttatgttccacatgttcctggaagaccaagagctgagctccttcctttcctgggagggggacacagcatgggccaatgctaccattcggaccatggaggctggtgatcaggaactgtcttgctttgcatctctgggtgcaatggaacagaagacaagaaagctagtgcatagctaca

SEQ ID NO: 70497 - DNA, 273 bp, Homo sapiens
ttatggaagaaaatataggaaaatatcttaactttgtgttaggcaaagatttcttatatattcaccaacagtacaaaggaggtatgtctagaatatagaatatttaaaaagaatactcttacaacacagcaataagaagtcaaagaaacttggctcacgctaaggttgtaatcgcagcactttgggaggctgaggcgggcggatcacaaggtcaggagatcgagaccatcctggttaacacggtgaaaccccgtctctactaaaaatacaaaa

SEQ ID NO: 70498 - DNA, 3574 bp, Homo sapiens
  misc_feature (1824)..(1824): n is a, c, g, or t
  misc_feature (3565)..(3570): n is a, c, g, or t
  misc_feature (3572)..(3574): n is a, c, g, or t
tgctgggattacaggcgtgagccactgcgcctggcctattgcttttatttttaaatttggagaaattatgtagctcaattcataaataagtagatgaacgaagcaactactttgttttcccaaatctttgtttcaaataagaagggaaatatcgtgattgagaggtctcttcccttcttttagtaaaaataatgcaataccgcgtttaagggcatataagtgaatgagagttagtattgaccttatgctactgtgatatatgtcaattaaaaaaatgctaatgtgtcaatttcgggaggataaagcaaaaagaaaaaaatgctaatgtgagaacaagcatgccagcaagccatggtcaccccacacccaataaaacaggtaaacaggaaaacacaaaaagtacctgtgagtatgaatagtatatataaaatattttcaaagaaacaagttactcttatgtatcttcaatagaaaggaaaaactattatttattcagcttatgtataattatgttttctgttgctgattcagttacttttgggaaaggcagtacaagtaaagccactcaatatggctttgtgttggacattcgtagtttcttagaacagctaacgaaaatgtagcttttatgccctttgttttttaacataaagaatctgagattgaagaggtagtgtgttcaggattacagaatgataaatggtggaatctagactcaaatgtaaagcagtattatttccaaagccagctacttttgtgttcagctatattgtttttgaattttcagtgatttattggtaggctttttgttatctgggaattccttctattaaaattatattgtcaagtgttgaaatatgcaggttttaactagttgcattgacacagcttgattttgtgtcactctaaaactcaccccctgctcccccagggagcaaaaacaaataaaaaccacatataaacatagctttctaggaacagtagtttcagatactgcttcctaaattgttcaaatatcttagcttttcagttctgtttgttccaaggtggtcatatattgttatttttcaataatcagatttagttgttttgccatttttgtttagggagttactattaattgttttttaatattaagcatgataaacttcagatgtttctctttttaaagacctggttttcgtatattgagtggtttcacttttgttaccttgccccaaagtaattgaatcagcaacagaagaaagcatgacattttaattgtctacgtcaaattacataatctagtgaagtatgaagactcactgttaaattattaatgacttttgtttattaaaccaagcagtgaaagagatggtatagggacattcccctcatattttataagtcatactactggctaaatagtatcaggattgtttttagctctgcattgctaactgagtgatctgtctaaaacttaaattagactgtgtccctcctttgcttttaagtcttaaaaactgctgcttaccagtcaaagtctatattacttagtatggtatttaaagcttttaagttctagccccctgctgactaccctaacgtcattcctatatatttcaaagcctatcctaccgaagtttgtctgctggcaacactaactactatttttctgtatgtagagagattctacactttggtttatatattctattctgtcctatttgactgttttcccttaccaccagactatttggtctcctttttccccacatttgtaactttttatattctttttaagacgtgctcttgctcttttgctcagagttgagtgcagtcgtnaatcatagctcatcgtggccttgaactcctgggctcaagcaatcttcctgcctcagcctcccaagtgtagctggggctacagacgtacaccagcatgcctggctaattttatttttatttttatttttagagacagggtgttgttgtgttgcccaggctggtcttaaactcctggcctcaactcctgcctcagctgggattacaggtgtgagccactgggctgggtggctatcatgttttatctaaaattagaaactccttgaggcagggaccatttatctttgtatctttagtgttcagcacctagtagtaactcagcaaatgtttgttttctttctgacatatttgtcatatttgtatttgttgtatttagcatcagaaagccaaatatggtcattcaacgttaatttgactgattccttttgttattttagtccagaattgctaccaaagtgtttaggtttgacctttttgtgcccaggaagtctagtcgttttgatgataaatctaaattggttgaggtgtaatgaaaaagacaaccaggtgtctagaagtgactgtgacaattgcagatttatcttgtttgtgcatgctggtttttttttttttcagtgttcaaagcctgtattgcatcaggttttcaggtttagatttcctaaatttggaacacaaagttccctttttagaagaataggtattgagcccttgagcgtgggtagaaagatagagacagagtgatttgcaaaataatggaggatcatatttatatatgaattttcacttatttgaactttcagatatcagctcaaaagctttggtataagtaaagtatattaatgagactccttggatgaaagtaaccaaaaccagtaaaaataaggtaataaggatgtaatagtttcttatggacactcaacagctagaatgcagttagtctcagaaaagaattagaacaaataactggaaggccatcaggagtccaaaaccatcactcttttatattttatattttatttttctctcttcagatgagcattctctttctatgtccatatggtagaaggcggcagctccatagattatggcttcagatgttacagttccgctaaatgcagggacagacttgctatctttcagtcccacttacatatcctggggagagagcaaatgattgactggcttgagtcaggtgcccgttccctttccaatctgctccatctaggagggcagtgttacctggtaccaaaatagatgttagagggccacccctttcaaaagggagaatagctctcacaacagggcttctatgttgtgcaggttgcttattccacatgctgcttgccaagctgtatgcctataagggctgcagttttaaaatttgtacaaaggtgctttatggatttgtggtaaccttttctcagagaaaggaggagtcattgtgaattggggggctattccaagggggtctgctatgtcatttttgggggatatttattgtccatcttagtattgccagactcttagcattgaaatattagattgtctctcacccttgggccatggagttttattgcagcaaaaacaaaaatccatatgtatataagtgttttctcaataggtatattgacagtggacttactatgatgtggagctttgacatttgtggacctgctgcggtgtccttacactcattgagaaccattgatgttacgcaaatgctattaaactttgcatctaagannnnnnannn

SEQ ID NO: 70499 - DNA, 2189 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccacttctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70500 - DNA, 2331 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagccttcctaacaggctccggcaggcgttagggccttcctaagtgctacccgaatgcgtgtccagtgggaggagaagggggaggaccaagaacctagatgaatggccctagagagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70501 - DNA, 2284 bp, Homo sapiens
gagcgttctgaacacctccccgtcccagcccctgggccaggcaagggccggccttacctctcctgggttggtggcagcagagctgggctctgagggaggcctgcaatgtgagacagtagcagctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70502 - DNA, 2391 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacaggtggggccgggaggtggtggttgggggtctagtatacagagaagctataggtaccataggtacctggaagggggctgatgggaggctagggtggcccagggctgggaggaggtgtgcctgggaggcagttcgtggaggtggcactgacagccgtccacacgcactctctgtagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70503 - DNA, 2014 bp, Homo sapiens
tgcctgggatggacgagctgggaccggaggcagggtcttgcctgagctaaactgaggctaggggagttgcctcatagttctcgcctgttatttccccagccccaggtcagtggaataacctgtcctcctttctctcccatctcttccctcccttgctggtggtgtcccttcagctgcagaggatgttgccaagcctgagcctcacaggtggggccgggaggtggtggttgggggtctagtatacagagaagctataggtaccataggtacctggaagggggctgatgggaggctagggtggcccagggctgggaggaggtgtgcctgggaggcagttcgtggaggtggcactgacagccgtccacacgcactctctgtagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70504 - DNA, 2116 bp, Homo sapiens
ggcacgagggtccagctgcgcctggaaagcgagctcggacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70505 - DNA, 2218 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70506 - DNA, 2873 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaattacccag

SEQ ID NO: 70507 - DNA, 1723 bp, Homo sapiens
  misc_feature (1)..(1): n is a, c, g, or t
ncggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccacttctgcagccgcccactctgcagccgcccgtggtgctgggtccccctgctccagaccccagccccctggctcctccccctggcaaccctgctggcttcagggagcttctctctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaattacccag

SEQ ID NO: 70508 - DNA, 1985 bp, Homo sapiens
tgcctgggatggacgagctgggaccggaggcagggtcttgcctgagctaaactgaggctaggggagttgcctcatagttctcgcctgttatttccccagccccaggtcagtggaataacctgtcctcctttctctcccatctcttccctcccttgctggtggtgtcccttcagctgcagaggatgttgccaagcctgagcctcacaggtggggccgggaggtggtggttgggggtctagtatacagagaagctataggtaccataggtacctggaagggggctgatgggaggctagggtggcccagggctgggaggaggtgtgcctgggaggcagttcgtggaggtggcactgacagccgtccacacgcactctctgtagatgcagtgcagtctggcccccacatgacaccctattctttactcaaagaggatgtcaagtggccgcccacttctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacaga

SEQ ID NO: 70509 - DNA, 2024 bp, Homo sapiens
gagccccaggactgagatatttttactataccttctctatcatcttgcacccccaaaatagcttccagggcacttctatttgtttttgtggaaagactggcaattagaggtagaaaagtgaaataaatggaaatagtactactcagggctgtcacatctacatctgtgtttttgcagtgccaatttgcattttctgagtgagttacttctactcaccttcacagcagccagtaccgcagtgccttgcatatattatatcctcaatgagtacttgtcaattgattttgtacatgcgtgtgacagtataaatatattatgaaaaatgaggaggccaggcaataaaagagtcaggatttcttccaaaaaaaatacacagcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaggggaagtccttaggcatgatttttgagaaaagaagtactcgaacaagattgtctacagaaacaggctttgcacttctgggaggacatccttgttttcctaccacacaagatattcatttgggtgtgaatgaaagtctcacggacacggcccgtgtattgtctagcatggcagatgcagtattggctcgagtgtataaacaatcagatttggacacccttgctaaagaagcatccatcccaattatcaatgggctgtcagatttgtaccatcctatccagatcctggctgattacctcacgctccaggaacactatagctctctgaaaggtcttaccctcagctgtttcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaatttataa

SEQ ID NO: 70510 - DNA, 1803 bp, Homo sapiens
gagccccaggactgagatatttttactataccttctctatcatcttgcacccccaaaatagcttccagggcacttctatttgtttttgtggaaagactggcaattagaggtagaaaagtgaaataaatggaaatagtactactcagggctgtcacatctacatctgtgtttttgcagtgccaatttgcattttctgagtgagttacttctactcaccttcacagcagccagtaccgcagtgccttgcatatattatatcctcaatgagtacttgtcaattgattttgtacatgcgtgtgacagtataaatatattatgaaaaatgaggaggccaggcaataaaagagtcaggatttcttccaaaaaaaatacacagcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaggggaagtccttaggcatgatttttgagaaaagaagtactcgaacaagattgtctacagaaacaggctttgcacttctgggaggacatccttgttttcctaccacacaagatattcatttgggtgtgaatgaaagtctcacggacacggcccgtgtattgtctagcatggcagatgcagtattggctcgagtgtataaacaatcagatttggacacccttgctaaagaagcatccatcccaattatcaatgggctgtcagatttgtaccatcctatccagatcctggctgattacctcacgctccaggaacactatagctctctgaaaggtcttaccctcagctgtttcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaagcatgatgcgtccggctcatcctctcattcggtgccagtagccccaccaaccgtcatct

SEQ ID NO: 70511 - DNA, 514 bp, Homo sapiens
gacatatggggcccactccgattcctttgactcccctctctttcctcagaacatctgcaattgttaattatacattacggtttcaataacttcttccttaattcttttgctgttccaggaagtgtgtgtttgtgcatgcacgtatgtgcacatgcctgtgtgtcttcaggtgctcttgttttttctgataaaggccaacatgcaaagaagaccatcttccccaagagcagacaaggcctagaagagataggttcaaagaataaagggaaactgaacatggcccataccctccaccatgtacaattaagtgagaagatgagagaatgcatgtaacagcctaacacttaaaggcactatgaaattaagagcaaataactgtcagatggtaaatgagagccatttgctaattcctttagttacctgagatgcagaccaaagagtatacgtggaaatcacgtatctcctcccagcaaaataaaaaacaaaactcaaaaggttcttagcataaaaatgg

SEQ ID NO: 70512 - DNA, 467 bp, Homo sapiens
cagcctgaagagtacacgccgacggacagacagacagtgcagtcacccataaagtagaaagcactactaacagcactggagggtgtagtgtttcctactttatggatgagtgtactgtgggcttcggagatcacgccactgctgccgcccgctgcccgccaccatcttcctcggcgctcggggacctcgtgtgacaggtgagcaccttacggcccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttc

SEQ ID NO: 70513 - DNA, 473 bp, Homo sapiens
  misc_feature (73)..(73): n is a, c, g, or t
cagactctggcccttcagaactgccaggccccactcacaccactacaggctctacctatagtgccattaccanacccacagtgctccaagccccctcactcacactactacaggctccacccacaagcccataatctctacccttactactacaggccctaccctcaatatcataggcccagtccagactaccacaagccccacccacactatgccaagccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttc

SEQ ID NO: 70514 - DNA, 189 bp, Homo sapiens
gtcagcactgagcctccacttgcaattttgtggtagaccttccaactttcatggacaagcctgcagccagagtccagaaaataacaatcaattgctagacattgctccagagctgcatatagattaggctcacttgcagaggaagcaagagctcaataaaacaccaaacaaaaaccatcctggggaaaa

SEQ ID NO: 70515 - DNA, 4151 bp, Homo sapiens
  misc_feature (1387)..(1387): n is a, c, g, or t
agcggagtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggangaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataa

SEQ ID NO: 70516 - DNA, 2424 bp, Homo sapiens
  misc_feature (1387)..(1387): n is a, c, g, or t
agcggagtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggangaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatatactcaagatgaactgaaagacagcataacatagtgtgccaaggtctttaatttgagactcctatatcccagtgctatgtcattcattggagg

SEQ ID NO: 70517 - DNA, 2749 bp, Homo sapiens
tacagggcaaacacatttcttaataagtgcagtttgttaaaatcatgttaaaacatatgagtcaaggggaagtaaaaataaagggtatcactgtaggaaaagcttttgggtctggcacctgggagaccactggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataa

SEQ ID NO: 70518 - DNA, 2312 bp, Homo sapiens
  misc_feature (55)..(55): n is a, c, g, or t
tagaggatccctgtgatccgacacctctttttgtctgttagttatttctccaggngaaaaggcaataattttctaagacccgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataa

SEQ ID NO: 70519 - DNA, 2503 bp, Homo sapiens
  misc_feature (1387)..(1387): n is a, c, g, or t
agcggagtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggangaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaac

SEQ ID NO: 70520 - DNA, 3362 bp, Homo sapiens
agcggagtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataa

SEQ ID NO: 70521 - DNA, 344 bp, Homo sapiens
ttattatatatttttatataattatatttatatgaataaataaaaccataaatgaatatatgcatgtatatatacacaacacaaataaagctatctgttcatctttcctctatctgatgatgcaacaggcttaccatataagaaatgccatgaaatcacaggacacgctacagaaaggagggtataaaatataactataactatattaactactaataccagcagtaactggaggaatattccttgcctggaaaagcaatttcaattaacagaattattttgttgacaacaagttttttatttaacttgttaagatcatgtagggcaggattgggagaggcaaa

SEQ ID NO: 70522 - DNA, 323 bp, Homo sapiens
cggcactgttctcaatagcaaagacttggaaccaacccaaatgctgatcaatggtagactggataaagacaatgtggcacatgcgcagttcaatgtggctggatcatagaatatgaagtgatacctgattctaaatcaggctgggtttataccatgcaggaccttgaggatcctgttaaatatctgggactgtatttaaacagtactgagaagctagcaaacttgtgaggaacagagaatgatataattcatatttatgtctagaaaagatctctttcatagatctgggtcaaaagtggattagaggggtcaagaatatattt

SEQ ID NO: 70523 - DNA, 259 bp, Homo sapiens
gtaatgggaaaggtattttatttctttttgaaattatttccagctgaatgatgttagtaaaaatacagagagaatacaacaaatgacatttagtaattttttctgactaacccattttagggttgtttatatacaaagaagaatatgaacaagaacaaatttaataaatagctgtagcctaatacacaaccgaaagaccgtaactccaacagcagagataccctgagaacagaataaggaggtggtgctgagcgtgtaa

SEQ ID NO: 70524 - DNA, 326 bp, Homo sapiens
tcacagaagtaatggaaatggcaagtaaatatatgaggaaatagtaattatcaaaaaatgcaaactgaaacaacgagaacttctgtctatcagactgctgacaataaaacatttattacatactaatggaacaggtctgagaaagtgggcattttcacacttttttgaatgagagtataaattagtacaatcttttcaaagagcagtttggcaacattccacaaaatttcaaaattatacattcttaggctcttctaaaattttatttttctttcttagtcttggtaatagtttaaaaaaactgttgaaccagcagtgggattgag

SEQ ID NO: 70525 - DNA, 397 bp, Homo sapiens
atagttcctaatgatttgtgtctatctaatgggttattgagaaaatcaaataaaataatgcatgcaaagtacttttagcacaggtccaatatccatggtaagaatacaaatgtggctgggcgcagtggctcacacctgtaatctctgcactttaggaggccaaggtggacagatcacctgaggtcaggagttcgggaccagactggccaacatgatgaaaccctgtcactactaaaattacaaaaaattagccaggcatggtgggacacacctgaaatcccagctactcaggagcctgaggcaggagaatcacttgaacccaggaggcggaggttgcagtgagccaagatggcaccactgcactctagcctgggcaacaagagtgaaactccatcta

SEQ ID NO: 70526 - DNA, 925 bp, Homo sapiens
gaaaaaatattcaaaatggaaagtccatttatgaatgtattaatattaaaatccaaagttatgtttttttataatgtctacattataatgtttacaaaggccataaaatcatttcagaaagttctcatcctccagatattgaccaataaaacttcatttcctagaaaaaagaagaaatgttataatttatacaaagatgaagtaagattttggaattacgtatacttacaccttcattttggatttgatttttgaatggatgcttaaaattctgatattcaactaatgacttagttttaccatcaaaaaatttagattatgatttttttgcatctcacttttcataataaatgtaatatagatacaatttattctgttttttgttgatgttattattgtttccactgctattgaaatcgttcttttaaccatgaatgtgcagaatcagttgattttccatgtgacagcttctgctaggaatctgcagtggaactggaagtatttgcaatgaaagaacttttttctttaattaaaatagaattcccatagaatcaacaattcctcctggtcatcaaacgcgaggtttttcctgtacttggtagagcagagtgtgtgtgtgtttgtgcgttgtgtgtgtgttgtttggtgagaatgatgagagctgagcattgtgaaaatacaggcgggggtggggtaacagagctgggtaggggtccagggcgcttagattgccttattgtccaggcttagatgcctcttacccagagccatcaggtgtaccctatatagctccagcctttctgcctactcctgagaagataaactgggatcctgcagtctggattcctagaaggagatggaaagcccagccatatccccagtttgacttgaccagtagtaaaactagcactacagtttgatccct

SEQ ID NO: 70527 - DNA, 2117 bp, Homo sapiens
taaagagatcagctgacttgcccaaccttcacctaacagccagtgtgcaaacccaggtgtggtaggccccagggcttgtctcagagagaaaacacactagggtttgtggaactctgattgagagcttcaggtaggttaaggccacactgttccttcactttctctcctcaattctgttttcagggtagagaagttacccagtcctgccaccccacaggcaactaagctctaaattccaagaagagagaacaggtaaccactgagagtcatgggctggtgagggccaggtatagttatccctacattgaaccatttcctttatcttacttagtttggaaaaactttgcagataaggctttgtacagaaaacttcaaaggaaatagtttcctaatctggcctagggcacacaggtaagaaaagaagaaacatcctctaagcagattgagggagagaaaaaagaatgcataagtcttgagggaattgagacaagctgggggcctcatgctattgtgagtctccctgcagcccaagtggaagcttggctcctaacaagcacaagctgccaattgttaccttcttctgagagccttgctaaaaaagtaactctgggaaaactcttataggttcctgaccatgaatccatcttttttattccccccaaaagttattcaactattagatcaatggataataactatgaggttttgggtgactatttagatggaggaaagtgtattaaggttggaaactaaattctatccttaatactactgttttctaatttttgtttttttgcctgatgtaaatgaaaggcatatatgttaaagattggctttaggaaaaaaaaaaaaataccctgtgcaaagtttatttcagcttgacttgacctacagtctacagacctggagtctataattaccagctgtggtgaaatgaatgatagatttctttctacctgcatactcaatgcagttgtgcaaaaaaagccccgcggggttgggataagacgtagaaggctgagagggctcaaaatggatttcactgagagtttggcatgggataaccctatagtcaatgtctgttatggtaccctgtatgctcatggccttcttggagacagggctcagaggtcattccttaaatacagacagaagtcatcttagtgttcagaaccattctgtgatcagtggccttagaacatgttccctctactgttccctacccagaggggatcctgtggcagactggtgatccccactgtttagaaggtggagagggagagtaaatctgggtttctatataagaaaataggttatttcgtggcgtcttaaaattgtatcctgacaaaagctgaattaggaggataccaccctatccccacaatggagatcacaatgggtaatttgttaagttccttaaatttttcactgataaaaatggaagtaaagctaccattctttgtgtacaatgtaaatttaatgtaaaactgcatcagaattaccataccaatgtccagggactagggagtacatagccattcattctcgaatcctgccattcattcagcatatattgtgtgcccgtagtgttaaagcactagtcctggtggagtaagcccatggaagaactaggctgtaaggtgtctagactgtcttcctcactgcttcctggaaggagggcatccaatttatttttaaatgtttttattctaacataaagcaatccattttttgttctgttatttaacagaaactttagtatcaactctatttcatggttgttgcagttgaagtgtttctggtttattttttgctcaatgtgtaaagaaacctgctgtgattattttacagatgagaaacaggcagagaggacaagggatttaaaaagtttcacagttaattagaagtggggctccaacttgacatcaggattcctgacatctcatttctcaaatagttgaaagatcacttttgactttcaagtaactccttatttttacattggttaatactgtttcttagctgtttgtacctgacattttcttaacacatatccaaaaaggtaaaagtttcattaaaggattctaatgatcattttagtatgaataacaaacatt

SEQ ID NO: 70528 - DNA, 535 bp, Homo sapiens
tgccatgttattttaatttattagagtctggttccacagaggagaacttagccttacatgttagaagcctggattgtctatccaggcccttttctggacttagcaaagtttaagaatggatatagtgctgaaaggtcataagtgtagacactacacactacagcaagatgttggctctctaccctataaggtgaatgaccttctgagttagtgatgcctcaccaattcccatgttccctaagtccagagagcctctttcttccaaaggactctttgaaaaagagaaggatgttcatacagaaaagcaaaacatatcagaaattgaataaagattgatggaattattttgtaagtatatggttgctacagcaaccattaagcttaagacctaacctggacaaatcacttgctaaagaataataataattgcttatgtttcttgcttatattaagttttatatgttgttattctaagtgttttgcctacattaattcatttaaccccatgatatagatactattaccctcactttac

SEQ ID NO: 70529 - DNA, 1191 bp, Homo sapiens
attcggcacaggatagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctggaactctatgaggaaataccattctcattttacagaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagattgagaacaccgatctggaatgggggggattgaaatacac

SEQ ID NO: 70530 - DNA, 1191 bp, Homo sapiens
attcggcacaggatagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctgaaattgaacacaaatgtggtggagacgggacagggcaggtggaaattcacttataagtcctgattggctaagccctggtcacgagaccgtaaaagagcaacgtctgtctcagagcgactcccacagcgtccttagcaaccagccttggttcccagcggctcagagcgcagcggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagattgagaacaccgatctggaatgggggggattgaaatacac

SEQ ID NO: 70531 - DNA, 896 bp, Homo sapiens
attcggcacaggatagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctgaaattgaacacaaatgtggtggagacgggacagggcaggtggaaattcacttataagtcctgattggctaagccctggtcacgagaccgtaaaagagcaacgtctgtctcagagcgactcccacagcgtccttagcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaagattatttccttgggataaagtttctacaatgagtgcaagagcaattgaaaagaactttcacaaagactttacagtcacaaataatatactttttctagttgttttctgtgctatccttgtcccaataccatagtgatccatattgtaaaaaaaagtagcaggagaagttgttatccacctagaatcctacagagaagaaaataaaattcaaaatatatcattaaaaa

SEQ ID NO: 70532 - DNA, 1328 bp, Homo sapiens
attcggcacaggatagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctgaaattgaacacaaatgtggtggagacgggacagggcaggtggaaattcacttataagtcctgattggctaagccctggtcacgagaccgtaaaagagcaacgtctgtctcagagcgactcccacagcgtccttagcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagattgagaacaccgatctggaatgggggggattgaaatacac

SEQ ID NO: 70533 - DNA, 1679 bp, Homo sapiens
attcggcacaggatagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctgaaattgaacacaaatgtggtggagacgggacagggcaggtggaaattcacttataagtcctgattggctaagccctggtcacgagaccgtaaaagagcaacgtctgtctcagagcgactcccacagcgtccttagcaaccagccttggttcccagcggctcagagcgcagcgaactcatctgaaagacttttataaatgacagtgcatcaacagttgagcatgtgttaacgtggagtggtatattaatagaaagaagcataatatagcacaaagcactcagtcaagcttctagtccagaaagcgtatgattttatctgaagtaatttggaataaatttacttgaaggcaaggtattctatatgagaagttaggccaaatgttgatttggacaaaagtgaatgtagtaaaatgggaaaaaaatcctgaaggctggcatcaaaataactcttaaacaatgaactattacagagatttccacttgagtcatgacttatgccatcttcccctcaagtgcaacataagaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagattgagaacaccgatctggaatgggggggattgaaatacac

SEQ ID NO: 70534 - DNA, 249 bp, Homo sapiens
ctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaa

SEQ ID NO: 70535 - DNA, 329 bp, Homo sapiens
ggttcgaatggcagcgggagtgttcttctgatattaattttgatttacattttagattacggtctccattataggaggcaatttgatcctcctctaccactgctccattatctgccttgctacttaatttcctactattctactatcttaaagggaacgtgctaggataacatgggtttatattttgaggctgttttactgtagactttctgaaagtcggaagcagagcagaccatactattcgaacaagagaatgtaaatggtagtagcgatgtaaatgactatgcaaactatattttaccttggttaaactgcaaagcagtggtatg

SEQ ID NO: 70536 - DNA, 569 bp, Homo sapiens
tcagccggacaccagaagacaagcagagagactcctccagacccactcagaccacgtgcacgccctccaagatggtatcccgtaaggctgtggctgctctgctggtggtgcatgtagctgccatgctggcctcccagacggaagccttcgtccccatcttcacctatggcgaactccagaggatgcaggaaaaggaacggaataaagggcaaaagaaatccctgagtgtatggcagaggtctggggaggaaggtcctgtagaccctgcggagcccatcagggaagaagaaaacgaaatgatcaagctgactgctcctctggaaattggaatgaggatgaactccagacagctggaaaagtacccggccaccctggaagggctgctgagtgagatgcttccccagcatgccaagtgatggccacgctggggagaaggtggacagatttgggaggcccctcctgcccaagtgaggccctgggaatttacagagcctgccagctgggcttggaaggaaaacaccctttccaaagcaaattcccctccagcaaataaagcatgaaatatacag

SEQ ID NO: 70537 - DNA, 525 bp, Homo sapiens
cacaaaaaaatttaataatgccaaattttggcaagggtggagggaaatatatattatcatgtaaatataaattattatgactttctggaagggaatatgataatagtaaaaactttagaaatgtgcgtaccctttgattctgcaattccacgtctaggaaaacatttatggatatacactaagaatgatgtacaagaacatttctcacattatacatgggagcaggcaccataccaagtgtccacagaggcagctaacatgtgccaggcatggtgccaagggcttttgcacttattcttatctaattatcacaacagttctatgaggtataggtaaaccattttcaatgtccaacagattgtgaaactaagactgagagaggttaagtcacttgtccagagtcacacagcaaagaagtggcagacctaactagcattgtctaacctgggcagtttcttaaataatctgtgatacatccatagaaggaaataactatgtggtccataaaagtcctcttagaagcat

SEQ ID NO: 70538 - DNA, 313 bp, Homo sapiens
atgaagtaatctttctccctctcttgtctcccttagatcccaagcagctgcagttttgggttatagtttgtcctgctacttaaccacctgccttttcagaggtccatgacaattcaattcagttctttcaggcatttatcaggctgcttctctaggttagaacctatgggggatgctgaaaattcatcttagtcaaagtcatgaccactgctttcaagttgttcactgtctagcagcagagctaggtaattaaacattcagttcaatataaacaatgctgtgatagagatacacatcgtgtggtgggttcaca

SEQ ID NO: 70539 - DNA, 494 bp, Homo sapiens
aattgttctctgccattgggttgtccgtgaagaatttcaacctatgaacatttctaaacattcagagaagttgaaataattgtacagcgaacacctgtacaccaaccatcctcccaattctacaatttatatgttactattcttgtttcattctgcctctatccttctatccctccatgttctttttttgatgcatttcaaagttgcccacatcaatccaattccccttaccccaacacttcatcttacactcattaaccagagttctcaaagggtttttaataacatgaaatgcttttttgaaaaaagtaagatgtaaaattaaacatactgcatggccttagccattcaaaaatatatcaaaaaggccaggcacggtggcttatgcttgtaatcccagcacattggttggccaaggcgaaaggattgcttaaacccaggagttggagagcctgggcaacatagtgggactctgtctctataaaaaattaaaa

SEQ ID NO: 70540 - DNA, 387 bp, Homo sapiens
gtgttaagtagattacattttttattctttctggccacttattctcttttgtaggaatctatcaacatgatgaggtaatttaagacatttttgtgacggtgaaatgaaccatcgcaaatgtccaacaaaaaagggaggcataagtaaaagatgacacatcttaggaatatactttcaaaaactatgttttcaaaagcattcctattcataataaaatgtgaacttcaaagtaatgttatgcaatcatatacatacagtttctaatatgaaattaattttctctaatagccacagtcacatacctgtgcatatgatagaatttatgttccagaatttttaaagtattacctctgcatagtggggcttgttggtaattattttgattat

SEQ ID NO: 70541 - DNA, 565 bp, Homo sapiens
cacaattcccaaatccttgcactaggtggggccagcctcctgttgtgtagactcatcaactataccagtcctctgttcctggtctctggagcttcaatttgggaaagtgacccattagcttctgaggaccagggtgagagagggcaaacttgaatgcccttcacaatggagagatgtgtgcagaccggacagacatcagttcctttatcagtgcacaggtagctgcaatgcctgcatgtggagagataaaacccagacaaagaggcagacatgagcagatgagctcccccgaacaggagacaagtgggctgagaggtgaaggaagaggatgagggcagccacgaacgctcaatgagacatgacaagtcaagtgtggagcccaggcccttcacccagaggagctcaaaaaatattagcagccgttaccattggagcctctgcctcctaaacctgcctcaatatctatggagggtgggagcagagtcacttttcctcactggacctcagtttactcctcagaaagacagcagtgatgatgccctctcaagatatcctctaactccag

SEQ ID NO: 70542 - DNA, 476 bp, Homo sapiens
atgatgatagcaggttccttccaaacaggaaaagaagtcgtaactgaaaaccctcacttcttccatccctgcagaaagccaagcctcttcaccacaggagactgttttgtttccttcttgagacagcaggaagtgggagacttggaaaatctattgtcaactgatatacgatgcacgcggacatgcagaagatgggagtgaagttgctgcttcagatcagtcacagtacttgcgtctcagtcacagaaattccatgagggtgggctgctatattcccactatttatgtggcgttaccagaggcaacttccaaaatccacgaggaagcaaaactgtgggatggctcattctcagaaacatagatggactttggagaacttgtctatgcattttttttgtttgtttgagaagacccattatggctttcttgtttatatcaatataggaaggaagctgtcaaaagtacacatgaatcac

SEQ ID NO: 70543 - DNA, 220 bp, Homo sapiens
cgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaattt

SEQ ID NO: 70544 - DNA, 692 bp, Homo sapiens
gattttgagtacaactgatataatattgcaagtatttttctattgtgcattttgtttacttgtattattaattgatattattccattattccttagaaaatattttaaatttgccctcagtgagacatttgcttaagtcagtaataggtctgcaatttagtgtcaggcttgaaatgtgacctagtgcggctcaggagacggggtattagggttggtagattgcccgtgaaagtctttgcaaagccaaaaattcatggatgaagccaaattcaggagctttgtcataattagacagtagagttcagagtgtggtttcttgatacattctttgtggtgctttccttttgcccttgattgcttgttttcccgcagtaatggttactctctctcaggttatttgaggagtaagtaaccgtattctaaatgtggttggtgaaacagcagcatcagcatcacctgagagctaggtggaaatgcagaatatcagacctactgaatcagtatcttctttttaacaagatcatcaggtggtgcacataaaatttaagaagtactgcaccaacagattgggaagaatagagagagagatctcactgagaacaggaaataatatcaagtgaaaaagacagtgggcaggctgaacaccaacttcaaaaacaaatccccaaacagaaacaaagccttttaaagaa

SEQ ID NO: 70545 - DNA, 531 bp, Homo sapiens
gcaacaagaggaatgaatattcctgaaggaggcagattattagacccagagtatactttctgaggtaccctacgcgaaggaaggatcattgcaccattacggagacgaggatacaaactgtcaggcctctgagcccaagctaagccatcacatctcctgtgacctgcacatatacatccagatgacctgaagcaaatgaagaaccacaaaaaataacattccaccattgtgatctgttcctacccaccctaactgatcaattgaccttatgacaataccccctccccgcccttgcaataatatactttgtcatactcccccgcccttaagaaggtactttgtaatattctccccgcccttgagaatgtactttgtgagatccaccccctgcctataaaaaattgctcctaactccaccgcctatcccaaacctataagaactaatgataatcccagcaccctttgctgactcctttcttggacacagcctgcttgcacccaggtgaaataaacagccttgttgctcacaca

SEQ ID NO: 70546 - DNA, 701 bp, Homo sapiens
gaagtgggaggggaaggagaaaagaaaagaaaaaattacagttatcacccattcttggcttccaaattaaatttaagacacattatcatttcaaatccacctgaaaaaagtaacccccaaatgtacttttgcctcctactgacggtggaacttgggcaagattcctaagtcttctgtgcctcagcttcctcgtttataagatggaattaaccagttgtacttgcctcataggtttgtggcagaattgaaataagacatgtagagtaagaatgaactacttttagtaatattttttgtcaacaccaacgtgaggaacgtggtggttaaaaaagcacagactcaacgggctgggttcaaaccctggctcttccatcaacaactgtgaccttgggaaagtttaggaacctccctgagcttctgttttctcatctgtggaattaagataaaaataatatttacctccgagggaggctgtaaggaggctctgacatgcataagcagtgtattaggtttacagctattttggtgatgatgaaaccaaggctaatgggaggtggcacccagccctagagcagctggctatatcatacgttcacagatatgcccaggacaatcacttgaacccaggaggcagaggttgcagtgagccgaggatctgccactgcactccagcctgggtgacagagcaagactctgtctca

SEQ ID NO: 70547 - DNA, 798 bp, Homo sapiens
catttattagctatatggctttgggtaaatttttaaaaatctatctgtatctcatttccttatctgcaaaattgaaaaattatacattaaatgctgattgaatgagaattaaatgagctagttcatcaaagtgctttgcacagtgcctggcatgtagtatcatttcatactggctgctgttatcatcatcatcatcatcatcatcatcatcatcatgtgggactgagacctgaaagaagccagtgtgcatcacagagatgagaaggggagaggaaggattcactgagcctctctagggctccaggcccagttcctttctgtttctgagtccagctgcatctctgcctcaggagtccatggctgaggctactcactatccttacagagccagctgcatctccttaattaagctcattctgctttattcctgttattatacaaacacaacattaatgtttgttaaaaaattgtttccctgagaggaaatgtgaacatctaaggtcttcccaagtatttcatttttaaccaataaggtgattggataaaccatttttgatagttcggtcacctttgaatattcctgcccttttatgtggtatataattcttagagaatagagattatatattgggtatggaggtcggggaagacataaccactaaatagagaggtggtgccctaatatgaatcctcagaccagggttgtttaatagaaatataatgcaagtcacatatttactttaaattttcaagttaccactttaagaaaaatctcgtgaaggccaggcacggtggctc

SEQ ID NO: 70548 - DNA, 744 bp, Homo sapiens
catttattagctatatggctttgggtaaatttttaaaaatctatctgtatctcatttccttatctgcaaaattgaaaaattatacattaaatgctgattgaatgagaattaaatgagctagttcatcaaagtgctttgcacagtgcctggcatgtagtatcatttcatactggctgctgttatcatcatcatcatcatcatcatcatcatcatcatgtgggactgagacctgaaagaagccagtgtgcatcacagagatgagaaggggagaggaaggattcactgagcctctctagggctccaggcccagttcctttctgtttctgagtccagctgcatctctgcctcaggagtccatggctgaggctactcactatccttacagagccagctgcatctccttaattaagctcattctgctttattcctgttattatacaaacacaacattaatgtttgttaaaaaattaaccaataaggtgattggataaaccatttttgatagttcggtcacctttgaatattcctgcccttttatgtggtatataattcttagagaatagagattatatattgggtatggaggtcggggaagacataaccactaaatagagaggtggtgccctaatatgaatcctcagaccagggttgtttaatagaaatataatgcaagtcacatatttactttaaattttcaagttaccactttaagaaaaatctcgtgaaggccaggcacggtggctc

SEQ ID NO: 70549 - DNA, 153 bp, Homo sapiens
gaagcctaatgatttgaattccagtgggtaaggaaggaagcaatgtttttatgtcctctccaccttggaacagggtgggctatttctccatttatgtgggctggcagcagatggggaggtaagggcttctcatgatccacagcaccacagtgc

SEQ ID NO: 70550 - DNA, 4664 bp, Homo sapiens
  misc_feature (33)..(33): n is a, c, g, or t
  misc_feature (47)..(47): n is a, c, g, or t
  misc_feature (2301)..(2301): n is a, c, g, or t
  misc_feature (2326)..(2326): n is a, c, g, or t
  misc_feature (2704)..(2704): n is a, c, g, or t
  misc_feature (2717)..(2717): n is a, c, g, or t
  misc_feature (2719)..(2719): n is a, c, g, or t
  misc_feature (3369)..(3369): n is a, c, g, or t
  misc_feature (3558)..(3558): n is a, c, g, or t
  misc_feature (3579)..(3579): n is a, c, g, or t
  misc_feature (3589)..(3589): n is a, c, g, or t
  misc_feature (3609)..(3609): n is a, c, g, or t
gagacacaattttactcttgttgcccaggttgnagtgcaatggtgcnattatcggctcactccaacttccacttcccaggttccagcgattgtcctgcctcagcctcccgagtagctgggattacaggtgcctgccaccacgctcggctaatttttgtatttttggtagagacggggtttcaccacgttgaccaggcttatctcaaactcctgacctcaagtgatccgcctgtctcggcctcccaaagtgctgggattacaggtgtgagcctctgcacctgaccctccttcctctttactaacagagattagcaaggaaggcaaaggtataaagaccagcatgaaatggaggcattcttctggatataagcttagatataccagtcaactgaaaaggaaacaaccttctcattctcagacgtaggatctgatggttttgctgtgtaatcttcccaggcctcctctccgctactttaggaaatgatgttgctttagagtcacactgctggctttgaagctgagaagggccacgagcctcgtaatccaggtggcctctagaaactgacaaagatgggaaactgccttctcccataaaacctccggaagaaatgcagccctgctgaggctttgattttaccccaataggggccgttttggacttctgacctccagaactacaaggaaaagcatgtaggttgtttgagtgattaacacaagtggggaatcacccactcaggcacagagccaagtccttgattttactccagcattgaacctggggacagaattcctgagataaagttaaagctctcctctttgtgtgtgtggaagggaaataggaagatgggtgtggagacggggagtggaaaagacactcactttctttgcccctaaaaagattctctgtgcccaactccctacacgattctggaagtatggagaaaatgcctgaactgcaaatgtgaagtaatcatctcatgagactcctcttaggatttctcttttcccattttctgcttgagtctgctttttctacttcctagagttccatcaaagccccgctagaatgcccaatctctttgcacgctaccaaggttttccgtggtccagggtgggacgtacaggcacaatatcccttcctaggagacttgtagcctgtagaggtaagagtaatgaacaagaggtaaacaaaccaaacaaacaacacctttcaagagagatctgcctgaggagcaatattggaaatcagaaatggctcatgaagtttgctaagcaaaaaaaagcaaatcctgcccgaacagaattagcaaaggaaccgatatgcaggcaaattcagtcacacgagggtggtccgagcagacacccccaactgcacaccttgctttagatcaacagaagaccgatggctgcaggtaataagggaagaaccacactcgggagaaaataacaccaaaaaaagtgaaaccaacaacagtcattgtgactgccacgacttagcatgcatgtaccacgtgttaggcacataggattccgacttctctatcctcacttgataatttctttgtctgattttgtaaaagagagaacaggcttggggagattacatgtccctcgcttctaggtagctgagcctgaatatgaatgcatgtttgctggagataaagccatcacacaggtggaacgcctttagagagtgtgatagacagaatcttgtctcatgccaaagatgcctgcatcgtaatctctgaaaggtgtgaatacgtcaccttgcctggcaaaagaaccttggcagatgtaataaaggatcttgaaatggaagagttgccaggattatccaggtggacccaaagtaatcacaaagttccttacaagaggaagaccagagaaggaggtatgtgatgctggaagccagggctggagtctgaaggccacaatgctggctttgaagatgaaaagggccatgagccatgtaatctgggtggcctctagaaaccggcaaagggaggaaactacattctcccaaagaacctccagaagaaatgcaacactgttgacgtttgattttactccagcaagacccattttggacttctgacctccagaactgcaagaaaatacatttgtgttgttttaaattacacctaaattggtgatcatttagttatagcaacaataagaacctcctacagaaatggaagtctaagcatgttcagaagcagaagaacggagcccccagagagagcgtgttggggggaagcacagattatgccaaattatcctagcagctgcagtcatgaatgnttaggatgtgcctagcattgttcanaattattatataaactaatttagtccccacaatagccttgtgaggctggcacaacctcacctccatttatcaatgaggtaactgggcagagagacagtaagcacttggtcccagattgcacagtgagtcaatgaggtgaacaaggattgaggacaaggcattctgaccctggagcctgccctcgtcatcccaactggaccctgcatggataattagagggccatattctggaagaaataggataggattcattaaccatttccacctaaatcacgggggttcagcactgtgccaggcacatggataagacatgcttggcactctgaaaagtagtttgggaggtgaacctgataagtgagttgtcagctataacccggnaataccttcctanangattgggcatgctggggagaaagtctagaagaggtcacaccagaggccagaggtatcagtggaaaagtcaaaggttcctgggaggaaagagaaggcaggcagacagacacacatcggggttagaagggtgcaaaggcagagtaacttggatgaacaagacaggcccaagccatggtcagaggctgggggtgcaggcctgcccagagccgcaggagaggacacccgaaaggctggaggagagaagatgaaatgccagatctcaggcaacacaatgctgagcagaggtaataatctgaactgcacggatgtagggatgcagagaagtagattgttaggagctgaattgtttccctccaaaacatgtggatgtcctaacccccagtagctgtgaatgtgaccttattggaaatggggtctctgcagaagatcaagtaaagatgatttggataggccctaatccaatatgaccatgtcctcactaaaagggaaaatagagacacagagacatccatgctcacggggagaactctatgtaaacatgcaggtggagattcaggtgacatatctacaagcaaggagcacccatgactgccagccaaccacagaagctggccgggcatgggggctcatgcctgtaatcccagcacttngggaggccgaggcgggtggttcacctgaggtcaggagtttgagaccagcctggccaaaatggtgaaaccctatctctactaaaaaatgcaaaaaaataagccaagcatggtggtgcatgcctgtaatcccagctactcaggaggctgagccaggagaattgcttgaacccaggaggcagaggttgcagngagctgaaatttcaccactgnactccagccncagcaacagagcaagactcngtctcaaaaaaaaaaaaaaatagttctgcaaatatttatggagcacccagtctgctctgaactaggctctttttaagtcccaagagttcagagatgaagaaaacgctgttcctgtcctcaaggaaatccaaacctatcaggatttactggaaacactactgatgtaccccttgtttttaacttgacaaagaacaaaaccataaagaaaagtttctagagattagattgcggttatataaactcacttttttttaatgcatacactcttatttcaaattatttcaaaataaagtcgcatttccacaggccagaggctattttcccataattttcttccagcattgtttatcctgtattttttatgagtttcggtgttattaccgagttttcaacaatcattaggtagtgcctgagacacaattgaatacaattttattaccccagccaacagacataaatatttaatccttccgctccacatgacaatgtatattttgggggggggtaataaattgctttttggggttgcccataggatgggcaccttctacaaatctgcttcgacgttttctctaatgcgctattgaatacatcaacactgtttgcagccctaagtgaggcattataatttttttttaatgataaagcaaagcgttccatcgaagacaaagtatcaggtggagatgagctcactgttcctgattctactgggcattctgcccaaccagaggaaggcagaggatttcttcagaatgctgcagaaggaccctgcagcctggcacctaacaaagctcaccttggaaacacaagggcagaaggaagtcaatgtcactacagagaaagcctgtggacactcactttgcttccagggatcagcagagggccagggaataaacatacagccctcagccactaataccaccgtgccaaggcagcaggtttcctaggcaggaccggctcagtctgtctcttgaaaataccatttccatccatggcatgcaaacttgcctcaggcattggagagaaattctttctaacagggatgattaacccac

SEQ ID NO: 70551 - DNA, 1041 bp, Homo sapiens
gatgtctttaagctgcagcagctattgttagttgtttaagacactccatcactgcctttgatcggaaactttctcatcaccattatgtgcatcggtgcaggcaccttaaatttcactgggtcttgggattagtcatattatagagagacacagagatgtgagaaataaattgaaaaaaggtctgtagcaacagattttacaccataaaagagtaaattattaggtgttaggaaaaatataaatgttgcaaacggtgtgttttatatactgttgccaagaataaaaatatgccaaatatgggggaaaaaggtgttggttaatctgacttctggctggcccccaccctgcagctcttagcactgctgggctgttttatagggcagtaacccagtcaccaaagcaaagagaattcgaataagggacttggaagatatgccaacttggggactaattattgccttgttaaacagtgagatggggttattgtacatttttgtgtatggtagttaaaatgtattttaaaaaagaagtttttagaaaccaagaattccccaaattcaagaagtaactgataaagtagtttatggaaatgtaatctccccatagaaccagattgtgcaacaaaaaaggagaaggaacgatgttaaatgggaaacagaatgggggtgacccttccagatggctttctggaaactcctttcaagccagccacccaccagacgatgctaccaaatggcccctgtattcgttttttagggctgccataacaaagtgtcacaagctgggtggcttacaacaataaaaatctaccattttacagttctggaggccacaagtgtgaaatcaagatgtcagcagtgccatactctctctgaagtctgttggagagaactcttctttgtctctcccagtttctggtggtttccagcaatccgtggcttccttggcttgtcgtcgcatcattccagtctcagtcatcatgcggcctcctcactatgtgtctgtctgtgtttacattttcctcttctcataagggcagca

SEQ ID NO: 70552 - DNA, 2936 bp, Homo sapiens
ggaatggcactcagggcaaaggcagaggtgtgcgtggcagcgccctggctgtccctgcaaagggcacgggcactgggcactagagccgctcgggcccctaggacggtgctgccgtttgaagccatgccccagcatccaggcaacaggtggctgaggctgctgcagatctggagggagcagggttatgagcacctgcacctggagatgcaccagaccttccaggagctggggcccattttcaggtacaacttgggaggaccacgcatggtgtgtgtgatgctgccggaggatgtggagaagctgcaacaggtggacagcctgcatccctgcaggatgatcctggagccctgggtggcctacagacaacatcgtgggcacaaatgtggcgtgttcttgttgaatgggcctgaatggcgcttcaaccgattgcggctgaacccagatgtgctgtcgcccaaggccgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttagctctttttggagagcggctgggcctggttggccacagccccagttctgccagcctgaacttcctccatgccctggaggtcatgttcaaatccaccgtccagctcatgttcatgcccaggagcctgtctcgctggatcagacccaaggtgtggaaggagcactttgaggcctgggactgcatcttccagtacggtgacaactgtatccagaaaatctaccaggaactggccttcaaccgccctcaacactacacaggcatcgtggcagagctcctgttgaaggcggaactgtcactagaagccatcaaggccaactctatggaactcactgcagggagcgtggacacgacagcgtttcccttgctgatgacgctctttgagctggctcggaaccccgacgtgcagcagatcctgcgccaggagagcctggccgccgcagccagcatcagtgaacatccccagaaggcaaccaccgagctgcccttgctgcgggcggccctcaaggagaccttgcggctctaccctgtgggtctgtttttggagcgagtggtgagctcagacttggtgcttcagaactaccacatcccagctgggacattggtacaggttttcctctactcgctgggtcgcaatgccgccttgttcccgaggcctgagcggtataatccccagcgctggctagacatcaggggctccggcaggaacttccaccacgtgccctttggctttggcatgcgccagtgcctcgggcggcgcctggcagaggcagagatgctgctgctgctgcaccacgtgctgaagcacttcctggtggagacactaactcaagaggacataaagatggtctacagcttcatattgaggcctggcacgtcccccctcctcactttcagagcgattaactagtcttgcatctgcacccagggtcccagcctggccaccagcttccctctgcctgaccccaggccacctgtcttctctcccacatgcacagcttcctgagtcacccctctgtccagccagctcctgcacaaatggaactccccagggcctccaggactggggcttgccaggcttgtcaaatagcaaggccagggcacagctggagacgatcttgctggcagggcctggccttgtccccagccccacctggccccttctccagcaagcagtgccctctggacagcttgactctactcccagcgctggctccaggctcctcatgaggccatgcaagggtgctgtgattttgtcccttgccttcctgcctagtctcacatgtccctgtccctctcgccctggccagggcctctgtgcagacagtgtcagagtcattaagcgggatcccagcatctcagagtccagtcaagttccctcctgcagcctgaccccaggcagctcgagcatgccctgagctctctgaaagttgtcaccctggaatacgatcctgcagggtagactaaaaaggcccctgtggtcacttatcctgacacattttcaagtgatacaactgagtctcgaggggcgtgtgttccccagctgatcatgtcagcctcatgccccaggcctcgtctttcatggaccaggtcttgttcaagcagcgagtgttgggtcctctgcttcctgagctgtcccctggagaaggtcccgaggatgctgtcaggagatggaagagtcatgtggggtgggaacctggggtgtggttccagaaatgtttttggcaacaggagagacaggattgggccaacaaggactcagatgagttttattgactcattcctctggttgatacggagccatgtcatgtgccacgacctggggtgggcacagggaggctgcagttccctacgtgaacctgccttgggcctcatctgctcctagcccagcagagagagttgacccctcctgaactggccactccccagtgctcctgtgcagggataggaagtgccccagggtgagaacgtgcccagccacatcatctttatctcctgggattttcattagggcaaagatctcagcagccagctcctggtagctgatgaggatcagagcgtttgttcccccatgaaaggggaaatacttaggtaatcattccaggtgtgttcagtagttccaggactcagggactcaggccagtcaccctgtgaccgcaggttgctttcccaccctgggcaatgcagtgcagcatgggaaaggaataagggggcaacaaggtgcacagacctcagagatggcttccttgtttatggggctctcacagatacccatccaactcctctagtcagcactagatcatgggatcctaaaataaaccttggaaaaat

SEQ ID NO: 70553 - DNA, 120 bp, Homo sapiens
agccttagtaatggcaatgaagtgcggggatagaatgttcactatttttttatgtgctgttaaaatttcatacctcctgttctatcttgaagtcttacagttttggaatggtgagtgggg

SEQ ID NO: 70554 - DNA, 194 bp, Homo sapiens
ctttttcacctatgaaagacaagaagaggccttctcacattcattacattcatagggtttctcaccagtaggaattctttgatgttgagtaagatgcgccctctgcctaaaggccttcctacattcctgacattcaaagggtttctcaccagtgtgaattctctggtgttaagagttgaacaatcaataaagga

SEQ ID NO: 70555 - DNA, 440 bp, Homo sapiens
cgatttgctgctgtgggtcatgggccagtgccaagaagcccaggcacgccaagcacagtgttttaggaaaaccgcggctttcagagagcagcttcaggataattgttcaattccattagggattctggctccgaatgcacctcggaacctggccccagtgtctcctccaggggaacttagaggtcccccactccataccttggctggctttctttttgatttgtttaattttcaagaaccatcattactggaatctcgtatctgattgcggtgttcatggaaagaaaaatgggaacaagggctgagagacagtgaggcttccagggtgatcaggttgactcgcagagggagaaataacagattcccaaatgcggattctggcacttacacgtttctgagtttccgatctggagatcggagaggtcaccgtcctagggctt

SEQ ID NO: 70556 - DNA, 1011 bp, Homo sapiens
gcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcaccccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgtggagtcattcctgtgagaaccagcctggcctgtgttaaactcttgtgccttggaaatccagatctttaaaattttatgtatttattaacatcgccattgggccccaaaaaaatgtg

SEQ ID NO: 70557 - DNA, 321 bp, Homo sapiens
tattcaattgcctactcagcttctctactcggatgtctaatggacaaaattaacatgtccccaaatggactctgaagctcctcctctcaaacttgtcccactcttaggattccccatcttgctcatgccagaaccattcttccacttgctcagatccaaaaccttggaatcaaaacccacatgtggttcatggaaaatcccattgactctatcttcaagatatatccaaagtctcatccctttcatcaccttcatacacaagctacagacataactcctgggttgttaccacagcctcctaactggcctcttcccatccat

SEQ ID NO: 70558 - DNA, 2999 bp, Homo sapiens
  misc_feature (538)..(538): n is a, c, g, or t
  misc_feature (555)..(555): n is a, c, g, or t
  misc_feature (2589)..(2589): n is a, c, g, or t
  misc_feature (2657)..(2657): n is a, c, g, or t
  misc_feature (2741)..(2741): n is a, c, g, or t
  misc_feature (2778)..(2778): n is a, c, g, or t
  misc_feature (2840)..(2840): n is a, c, g, or t
gatcacatggacacaggaaggggaatatcacactctggggactgtggtggggtcgggggatgggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaaaaaattaatctgtgtaatccaccatgctaaatgtatgaagaggaaaaatctctttagctttgactgatgcagatatcaatgcagaaaacacatttgacagaatccaattattgggtataatctttttaaatgctcaataaactacaaatagaagggaactcttcaacctgatcaaagataagatttacaccattataaaagagcaagtttgggctccttttgcctctttgcccttccaccttctgtgacatgatgatgtagcaggtgccttactggcaccttgatcttggacttcccagcctccagaactatgggaaaataaatttccnttcactataaattaccnagtctcaggtatgctgttatagcagcacaaaacagactaagatatattccttattgaacagaaatgcaaaatcctcaataagacattagtaaattaaatccaggaacatatataaaggagcatacaccatgaccaaatgggattatcccaggaatttaaagaaatttaataccccatgctaatagaacagaataaaggacaaaaaccatatgattgggctgggcatagtggttcaagcttgtaaactcagcattttgggaggttgaagtgggtggatcacctgaggtcaggagttcaagaccagcctgaccaacatggtgaaaccccatttctactaaaaatacaaaattagctgggcatggtggcacatgcctgtaatcccagctactcgggaggctgagggaggagaatctcttgaagccaggaggcagaggttgcagttagcccagatcacaccattgcactccagcctaggcaacaagagtgaaactccgtcttaaaaaaaaaaaaaatcatcttactaggtacagaaaaagcatctgaccaaatctaatacccattcatgatttagcaaaaacaaaaatgaaacaaaaaaattctttcaacaggccagaaatagaagggaatttcctcaacctgataaaaggcatttatgaaaagcctatagttaacaccatatttgccggatgtttcagaacaatgcaaggaagtcatgtctcactacttttattcagcattatacagggggttctagccagtgcatgaagacaagaaaaagaaataaaagcctcatagattggaaaggaagatgtaaaactgttgcagacaacaggatcctgtatatagaaaatcctaaggcactcacacacgagaaaaaatttactacaaccataaacaagttcatcaagttttcagaatagtaaatcaatatataaaatcaattatatttttatatatgctagcaaatcaaaaatgaaattaagacagtgattccattcgtaatagtatcgaggagactacttaggaataatacaacaaaaagataccagatttatacactcaactacaaaatgttgatgagagaaattaaagaagacataaataagtggagagacatttcatgtttaaaaattgaaagtctcaatattattaagttggcaattcttcctaaattaacacaatccctgtgaaaatcccagtaggctttttatggaaatcaacaagctgatcacaaaattcctgtgaaagagatccaaaatagcgaaaacaatatttaaaaagaacgaagctggaggactcacactcatctatttaaaagcctactataaagctataataatcaaaacagtgtggcagtaacataaagatatatttatatggaacagaactgacagtaccaaaataaaccttcacatttatagtcagttcattttcaataaagatgctgaggcaattcaattgtattttcaacaaattgtgctgggacaattgaatatctacatataaaaagaatttatacacttacctcacatcatacacaaaaattaattccaaatgaataaaaaatgcaagagcaaatgctataagattataagatatttagaagaaaacatagaagaatatttttgtgaccttgggttaagcacagattttttagctgcagcaccaaaatcataattcatatgtgaacaattaacaaattggatttcaagatttaaaatgttttcttatcaaaacacaacatcaagaaaatgagaagtcaagccacagattgggagaaaatatttgcaaatcctataatggataaaggactcatataaaaaatgcctttctttctttctttctttctttcttctttcctttcttccttccttctttctttcttttttctttctttctttcccttccttccttctttctttctttctctttctctctctttctttctttctttctctctctctctctctctctctctctccttccttccttccttccttccttccttccttccttctttcagatggagtctcnctctgtcatccaggctggagtgcagtgacacaatcttggctcactgcaaccgccacctcctggattcnagcaattctcctgcctcagcctccggagtagctgggactacagtcgtatgccatcactccaggctaatttttgtatttttaatngagagggggtttcaccatgttggctaggctggtctcnaactcctgaccttagttgatctgcccacctcggcctcccaaagtgccgggattacaggcatnagccactgcacccagcccacttacaattcaataataagaaaaataaacccatttttaaatgggcaaaaaatttgaatcatcattttaccaaagaagatatatgaatgaccaatgtttaagtaactcttaggaagtcaggaaaaagcaatgagaaatgag

SEQ ID NO: 70559 - DNA, 279 bp, Homo sapiens
agtggtagatctactaaatacagacttaaaaaaaaaaaaacaactcctggggctgtgaaagaaaacagagactttaaaacaactctcttaaagatgctcagaggaatgaagtccctgaccatccagctaaaccattgggtacagcccatgaatctgtatgtaatcacacatctggccatttctacttccatgcagagtacacaaccagttgcactgcttgaagttctgcccactgggaagatttcccttcactgttgtccttcaagaatgtcctagaaa

SEQ ID NO: 70560 - DNA, 251 bp, Homo sapiens
  misc_feature (44)..(45): n is a, c, g, or t
gaatggctccaagccaacctggggcctatcaaccaagaccaggnnttacttcacttcctggaagtaccataactcctcctcaagttgtgacaaccaaaaatgtatccagacatcaccaatgtcccctggagtgtggggagggaatctcctcaagttgagaaccacagcactagaaattaaagcagttagaaatcccagatattaacccctggaaagccacgtggactttattttcccagtttgataaatcg

SEQ ID NO: 70561 - DNA, 437 bp, Homo sapiens
gattcatatttcactacatatgtagtattttagctttataacttaccacacaaaattttagactgactaaaaaattcactagaaatagcaacaagtgaaatgtatatattaattttttaaataagtattttatttctatccagaattttacatatgagacatggtgtggttctaaattggtctcatgcaaaccaaaaaccagggtgcacttggaaaaagaaaaatgaacgttcattaaagttaaatcccacatcctaagtgtgaagtcttgaaaacactgaacaaagacttcacttgtccacatgtcttatttggtgtttttgttcgtttgtttgtttctgtttttgttttgttttgttttgttttgagacggagtctcactctgttgcccaggctggagtgcaatggcctgatcttggctcactacaacctctgcc

SEQ ID NO: 70562 - DNA, 204 bp, Homo sapiens
caatttatttctgaccaaataaaattttctgatgttcctttggatgaatgtttgtccatatctgggaactgtgtgctgtgacttggagaaatgatcactcccttagagtcagatgacctcaattctaaccacgctctaccatttatgatttgtgtgaccttagcaggttcatacttcctcataaagtgaagatagtatctgcct

SEQ ID NO: 70563 - DNA, 462 bp, Homo sapiens
gaaacccttcatgcattccttttgttcgaaggtaggggtggcgtggactgggtgggctgcagagagagagcttgggatagccaaaatcaagccagggaacagctcgaataccgctgtttgaaacctctccttctgtcttttatattctgtctctaaaaaagagatgctgtggagaaacaaacattttgccttgttggtcactgctggaaatagaagttttttcgctgcagggcaattctgtaaatgtgcttcccagctttaggaggtctgaggctactcttctccaataaccttccttcccactggaccttctcactcacagcactgctgccctctggacaagccacagtggacaaatatgtcaagctgaagatgcacaaataatttcaagttcagttctcagggattcaaaggacatgaaaattcttgtagcaaatcttgaataaagagttcattaaacca

SEQ ID NO: 70564 - DNA, 1059 bp, Homo sapiens
tgcataaaagaggcaaccccaaaagtgtagcaggtactgaataacagatttgcagccttgggtatccacattaaaatttgaaatctaagtgaattacttcaagctgatttcttaggtcaaggagagattatggtccttaaatgcctgataaggtcacatacacaatttcaagtgcattatagtaaatccatgtgacagctcctacagctactaacctgcttctgccctcacggtagcgtgcacaatcttcatcgcatgtcctgggtggtggtaggagcagtagaaaccccctgggtcatgtcagatttagaaaatataagcaatggctcatacacgaattttaagttgtaacctacatgtgataagttgctttatcttccaaatgtaataaaaaccagaagttactttgaaataaattgaaggattagcagtggtgactgaggaataaaaattataatttaaaattgtccttaaggctggaattcttaacttattgaccttatatcctacatattataggactttgtaaatttaggctgatatggaaatgtatatttatatcaaatttaaatttttagaatgatggtgctactatattctaattgttaatttgataattgtaattgtaatttgttaatttgttctaataatgttttcatgacattattcatttgctgcttggcttgatggcataacaagtatgggttatttaccctgaaaaggaaacagtatcacccttccagaatctctatttacagctacaaaagatgcaacacacctgtttctggaccacttccagatcagatgtgatgcatgctttagatcatttactttgatctaggaattactgtctggcatttcgtggtgtagggtaggtgtctccagcactgtataggtgtctggaattgagataagaatcaatttcaatacaaaatacattttttgcttaaagcacgcaaggattctatgaattcaggtaaattcacagggtggaaaacaggaactaatgttatatattcctgtagttatcttcataatgaagcagaaagaaaaacaaaa

SEQ ID NO: 70565 - DNA, 759 bp, Homo sapiens
ttttttttactaatttactaccttccttgatgtccacagatcctaccctcggccaaatcaccacctcctctccctgacatattatagtattcttctgacttgctttctacttgccccgttctgtgcctaaagaaagcacttcagtgggtttacgctgcgtgttcataccccctgaacctaaaataaaagttgaaaaaaaaatgaagctgtgattgtcgtggtcaacaacaccccaggggatgtagtcctgcctccctctcagcctcacttggaagcagtccttcgctcttccgtgttccagccgctctgctcttctcagtaccttgaacttaactcactctttcctgacttggaacctttgagatgttccgtctgcctggaactcaattccaaaccatccttgtgtggttggctccttctgtttctttaagtcttgatttaaaagttccttccaaaaaagagacttgctctgattacattcagtgttcctgcctcccaatcgtctgtaccacggctccatggtcacggcattcctcttccttctgtctcacatattacaggctgctgcgggggtgcaggggggaagctactgcaaaatccatgggatcagctgggcgtggtggcagtggctcatgcctgtaatcccagcactttgggaggccgaggagggtggatcacgaggtcagggtggatcaagaggtcaggagatcgagaccatcctggccaacacagtgaaaccccgtctctactaaaagtcga

SEQ ID NO: 70566 - DNA, 224 bp, Homo sapiens
aaaaaaattaaaaattagtaacattttaaccatttaagaccagtcacattcattataacatctgaaagcaggacaatggaactatttaaacttttagggaagtatcttaagaaagacaaacatataatcatatctcttatgaaatacacagctctcctattcaagccaaaggatctttctagacaaagaaacagattttggacaaaataagacactcagtattt

SEQ ID NO: 70567 - DNA, 240 bp, Homo sapiens
ttcatgctcatgtaaccttcttaatagtgccttgtctgctgggtttgtagctgtaagcagttctgcaaactggccctataaaaatattgatgctgtccattaaaatgaatctctctctctcactcagtctctctctctgtctgtctctctttcttctctctcctgccatgtgtgtgtctctctctactcctctgattttgtcctctctctctattctgctactctctctcctctcctccg

SEQ ID NO: 70568 - DNA, 1387 bp, Homo sapiens
ccggcagtcggagcagccttggagcaggaggagcagcagcagcagcagccgtcgccgtttgcggagcgcagccgagccggccatggcgttgtcgatgccgttgaacgggctgaaggaggaggacaaagagcccctcattgagctcctcgtcaaagctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctcttcaggagccctcaccattgtgtccattcactgtgtatagatggcagaacttttgaggtgcaatgtttaattgttcacaaattagtagaccacgaattgaataaggcagccccaaacgcgggcttactggttggtacacacaaaattttatggactcgggatctcgaacatggaccgagatctaaggcacgcacggtcaaaacatgggaaacaggaaccggaagacaccaatcaccacaacatcaacactccaca

SEQ ID NO: 70569 - DNA, 856 bp, Homo sapiens
ccggcagtcggagcagccttggagcaggaggagcagcagcagcagcagccgtcgccgtttgcggagcgcagccgagccggccatggcgttgtcgatgccgttgaacgggctgaaggaggaggacaaagagcccctcattgagctcctcgtcaaagctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgt

SEQ ID NO: 70570 - DNA, 844 bp, Homo sapiens
ccggcagtcggagcagccttggagcaggaggagcagcagcagcagcagccgtcgccgtttgcggagcgcagccgagccggccatggcgttgtcgatgccgttgaacgggctgaaggaggaggacaaagagcccctcattgagctcctcgtcaaagctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccagggggtgggggggggggggggggggggggggcatatggtgatgtagggggggactcaccaagtaaaat

SEQ ID NO: 70571 - DNA, 610 bp, Homo sapiens
ccactcctaaggaaggccccaagtgggtgagcagcccctccagcaaagatgcaggagcccctggcctagagctccccctgcccacagccccatctgccctctgtccctctgggtgttttcttttcttttcttttttttttttttaagagacagggtcttaatctgtcatacaggctgtagtgctgtggcgcaatattgcaatacagctcactgctacagccccaggcttaagtgatcttcttgcctcagtctcccgagtagctggaaccacaatctcataccaccacgccccacgcctggtaaatttttaaatgtttttgtaaagacagggtactgctgtgttgcccaggctggtctctaattcctagtctcaagcgatccttccgctttggcctcccaaagcactgggattacaggtgtgagccactgtgcccagccctgctctaggttttcatttggatttgctgcctagtggaaggcacaggatggggcagtgccttctgccagtgagggaggctccaggtagatgtcattgctgaactggagctcccctggaagcaatgtggcccagcccttcctgggcagccccttctgccaccaggagccttag

SEQ ID NO: 70572 - DNA, 152 bp, Homo sapiens
aacagaacagcctcagaaactgccaggctccccatcataaatcctgtgtggctcagaaactgccaggctccccatcataaatcctgtgtggctacaaatggtgagaattcaaggaaatggaaagagaccaattgccctgttgggaaaaccat

SEQ ID NO: 70573 - DNA, 540 bp, Homo sapiens
agagacagattcttgctatgtttccatgctgcttttgaatgcctggcctcaagaaattttcctgtcttggcttcccagggaaattcttttaatttcaaaaacatccttttattattcatgtattttaaagagatggaatcttgctctgtcgcccaacctacattgcaatggcaaaatcatagctcattacaacctcaaaatactgggctaagagatcctcccacctcagtctcctgagtagctagaattacaggcatgaaccatggcggccagctcaaaagtatccctttaaataggaagcttatacaatttccataatacattttaagatgtttaattcatgcataagactccctttaaaaatatatctactatataaatgaaatgcccacgctagtctcaaattcctgggctcaagcaatctttctgccttggcctcccaaagtgctgggctaataggcaccctgggagggcgatacagctggatcgcttgagccctggagttggagaccagcctgagcaacaagcaaaagcccgtct

SEQ ID NO: 70574 - DNA, 1927 bp, Homo sapiens
gacgagccgggtcactagtacggcgcagtgtgcctggaatatcggctaggcagttttcagaaagaagtttctagtaaacaaactcatctagagagagaaaaatgtgcatattatatccatattaattctattcatgcagcttctttgtctttttctctctccctctcacactctaggatagagttgcacacaaatatgagctttgtttaaaaggtgcctttgcaaacaagactcaactgtactttagagcagaaataaaatgatgttggtattctgttgttgaatatggctttggacaaaacattcaagccttctgagtcccagggtttttgtgctgaaaaatgattagagagctatttagtcatcactatactctttagatctgagcataaaaaaaagagagagagacaaaggaggaaaggactaaacaacatcctccaacaaatccttattgagatcaatgtcctcaaatgtcacatttgtatttcccagaaaatgttcctcccttcctgatccctgccaaaagatgaagtgtttcacttattacctataagagaattatattttgaaaaattccattctcataagtagccctagtatgccagtagtgtggagagaatttaatttttaaaactaacttttcaaagggaaaccaaaggagatgagtaccatttacaaatcagaatttaaaaaactggtcatattcttgccaccaaaggacgagtacacctgtgttaaattttacttgctaaaacaaaaaataagttatcttttgtacctaaaggggggtcatcaaatttcacagagtactctctcaggaactgtaatgatggtaagagagaaatcaaatagatgttagattaatgccacctccaccagaaatgtagctctttgtagtctgtaaccaatttagattggccctttttctctgatctaaatctagattggtagtgaaattcccaagtgctttccacttttatacacagtcatttgtcaatgctcctctctccaaggggctgcaagtgtgaaatccctacatgcagagctaaacttagcagtaagactgactctgccacacctgttacaactgtgcactgtcagagatgggagctgcactctgcatcattcaaaacaaattagcagataggctaagacttggatagggcatatatttttcaaaactcaaagtgactcacattattacaccttgatggtctaagttgtgtgtttattcaacacccagattcagtggaccctttaaaatttgagctttggcagccaaacatggacttcctcaagactggcaacaccccccctccagaacttcttaagaacacacatcttccctcattccaggctctcacttttgtgcccacagtatttgaatgcactttacatttgagaagtcagtggctggctaaatgaaggaactgattatactttcaacagcagtgaatagcaagatacaaaataccttgttgctgaatctaatagagatacagactgaaaatctattctctgcccatctgaccttcccaacccaaatttcaggagaataaaactgctttttaagcactgacttggatgaagatttctaatttatgattaggttactcacatggaaaactatcaacctctttcatcacaactaccccatggggatccagctcgtcactgagcattaaccaaagcacacagcacagattacaccaaaatagcagcataacaccccccacccaatttccagtgacaatataaatggaaatgcttttaagcagatgtgtcattataatgactcacatggtatttaatctttaggaaaataaactgaatgtttttattgtagcaaacttactgtaaagaaaagaatttttacattatatttattccccaatgtattaacatatattactgctcaaaaaggcag

SEQ ID NO: 70575 - DNA, 204 bp, Homo sapiens
ggatccggttgcagtgagccgagattatgccactgcactccagcctggacgacagagcgagactgtctcaaaagaaaaaaaaaagaaagaaaagaaaaaccaagacccaggaatttcctcacaataccatgtttatgaaactcaaaaacaggcagaacgaaacaccatgcttttcagcatgcagacatggttgataaaactttt

SEQ ID NO: 70576 - DNA, 367 bp, Homo sapiens
tataaactgtaccttaaagggaaagagtcaaatacacccacccccgctacacgcacagacactggtactgtctcttaaggcaaacaaacaaacaaaaattgatgaagggaagtttctttttatagaagtattctggctaagagaaacaaatgaaggaatgacagatcataaattttttctcctccaattaatatgttgaggcagtattcacatatctgataatatcacaaaaggagaaacaatcagacttatttatctaatgattgcatagaacattatggagtagtcctgctaaaggaaagaaaggaagaaaataaaaatctgaactgaatctgattaagactctatatcttactaccaagtttca

SEQ ID NO: 70577 - DNA, 1545 bp, Homo sapiens
gggaagaggagttaggctccggcagagcccctcagttccccagttctgtcatcctgctggcacggcccagtcctgaatgggacacctctccatccagctctgcctggcgtcggctgggcagcccttcccatggggctccagctgggggatggggccaatgcacatgagccacaggtgataggactctggccccaggtggttatacgggctggagaaggacatgcagaagacagacatccactaccactcgctgactggggaggccgacttcaactggcggttcatctttaccatggactacctggcggcggagcgcacgtgtgtccagagccagaaggtaacaggcctggggcgtgaggggcaacaggccacaacaaacagacccaggctcctggagctcctccccccacccctccagaggcttgcaatctgtcccagaacatcagaaacatgtcctcaggtggaaaccctcttccttgatagtctatcactgctgggtggagggccactgaggggtgcaagggaaacgtccaggagacaggccggtaacacgcccttccgccatttccccaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacagaga

SEQ ID NO: 70578 - DNA, 417 bp, Homo sapiens
gagacgcggtttcaccatgttggccaggctggtctcaaactcctgacctcaggtgatccactcacctcggcctcccaaaatgctgggattacaggcgtgagacactgtgcctggcccagtagttgcttttttaaaaaagaaagctctttgcatcagattacttgacctgaaggttctccctgccattctctgacatctccctggctcctggacagacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccggtgagtggcagccatgggggcaaggacaaaggtggtctcgggatgactctgggg

SEQ ID NO: 70579 - DNA, 749 bp, Homo sapiens
cgcccttccgccatttccccaggattacatatggagcctggatgccacgtccatgaagttcccagcccgacttatcatccaggtctgggacaatgacatcttctcccccgacgacttcctaggtgaggtcctgacacagggcttgtgaccacaggacagggagctccttcttgctgatgtcatttttctgggctcaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcggtaggagctggggagtgtctactgattagggctgctatgccacatgtcctggctctaacagacatctagggacctagctaaatcccttttcctttcttgatcccgggaagaggtcctaaaactacccggctcctgctgtctgcactcagcctccccctcacccatggtgttcctagggcaaggtgaagatgagcctggagattctgtcagagaaggaagccttaatcaagccagccgggcgaggccagtcggaacccaaccagtaccccacacttcatcctcccctgtaagggtccttggggcaaaagcaccagatctttcttgctcctcagtgtgtatggggtggtgaccagtgggc

SEQ ID NO: 70580 - DNA, 5858 bp, Homo sapiens
  misc_feature (597)..(597): n is a, c, g, or t
  misc_feature (1289)..(1289): n is a, c, g, or t
  misc_feature (1867)..(1867): n is a, c, g, or t
  misc_feature (2545)..(2546): n is a, c, g, or t
  misc_feature (4439)..(4439): n is a, c, g, or t
gatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggcaagcaagccaagcccaaggacatggtggccacagcggaggactggctgtaccgcctcaacnccgtgctccctgagccccagatgggcctccctgacgtgatgatttggctggtggcaaggagcagcgagtggcctatgcacagtacccagagggtgaaggacagaaggatgtgctcccagctcacctccgggtctgcatgtggcttggcaatgtcacagacagcaaggacctgcagctgctccgccagggtgacacagcggtgtacgccgagatggtgagtgtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagagggcctggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcntgggcggtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccncaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgaggtgctggcgatgtgggatggggacggtgggcaggacaggcgggggtggtctggagtgcgctgcagccttctgctggtcctccctgactactggatccaaagctcacaccccgaaaaagactacctgggaggtggagggagacaggagagaaacgaagaggttctggtgtaacactggaaatcattttaccacaaacctctgcagtgaggagtaggcaaagggctgtagcatgcatgatcacttgtgggactcacgctgcccctgcgcagtagcaactactttgcagagaaggaaatagaggctccaagagataacacattccacgcacagtgatgcagggactaactgacnnggccatttaggcccagccctgtctgactgcagatgccaggatgttgctcacctctcttctgagagtagcatgagggtcctcattcagaagctgtgtgccctgccgcaaatgtggcaaagagcacaagacggtcaggcctctgggactgaaggcttccccaagatcaggcaacttggctggttcccgctttaggccccgaggaggcccaaagtcagggtgcagctatttcctggcaggatgccaggtcactgaatggccatggggtcctcaatgagctagacggcacaggggccctgagaaatccaggcacttcctgcttcttcaggcctcagaggcagtcggcttcaggaactcctacctgagaactgatgaggccagacaaggcagcgggtgaggaggggcaatgcctgcgggctatggaggtcagtggaggatgcagccagtggccagaggtcacctccctcatgggttgggggacagcgtcccagccccgagggcaagcactgatccctcacaggacggggaagcctgtccttgtgcgccttcagacactggctcctctgcagccccattccctggccctgcaggctcctgctgcaccgctattgcccctcagcccccttctctggccaggaccccattacagaggcgctgcctgccccttgtcctgccctccttctttgttctggtagatcctggcctggggcttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgcttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgtncatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctataacagaga

SEQ ID NO: 70581 - DNA, 845 bp, Homo sapiens
gtagggaagaggagttaggctccggcagagcccctcagttccccagttctgtcatcctgctggcacggcccagtcctgaatgggacacctctccatccagctctgcctggcgtcggctgggcagcccttcccatggggctccagctgggggatggggccaatgcacatgagccacaggtgataggactctggccccaggtggttatacgggctggagaaggacatgcagaagacagacatccactaccactcgctgactggggaggccgacttcaactggcggttcatctttaccatggactacctggcggcggagcgcacgtgtgtccagagccagaaggtaacaggcctggggcgtgaggggcaacaggccacaacaaacagacccaggctcctggagctcctccccccacccctccagaggcttgcaatctgtcccagaacatcagaaacatgtcctcaggtggaaaccctcttccttgatagtctatcactgctgggtggagggccactgaggggtgcaagggaaacgtccaggagacaggccggtaacacgcccttccgccatttccccaggattacatatggagcctggatgccacgtccatgaagttcccagcccgacttatcatccaggtctgggacaatgacatcttctcccccgacgacttcctaggtgaggtcctgacacagggcttgtgaccacaggacagggagctccttcttgctgatgtcatttttctgggctcaggggtcctggagctggatttgtctgacatgcccctcccggctcggcacgccaagcagtgctccatcaggatgatggacgccgaccccaagtggcc

SEQ ID NO: 70582 - DNA, 1343 bp, Homo sapiens
aatagcactgatttttagtattttgagagtgtgttctggctaacattagttacaatagtttgtttcgattctcttggattttttgtgtatacaatcatatttttagtgaataatggtattgtttctatttttataacttcgttactttttcttgtcttactatgttttattacagaacaggagcagtgatagtgggtatccttgtcttctgacttcaaagagaatgcttctaatttttcaccattaagtattatatttattgtagattggggtagatatcctgcattagcagaaggaagaatttttctgttctcaggttactaagagttgttttttaatcatgaatatgtgtattttgaattttaccatgtttattctgaatctgttgaggtaacactacatttttctaatgttaaaccatctttgccccctggtcatgtgtattattttttcctacattattggattccttggctaatattttagaatgtctccatctgcaaactgaaatgagactggcctacagtttttctttcacataaaatccttgtctgattttggttagaattgagcaaacatgatgaggttataagagcttcataaaataaattgaggatctttaccttcttttctattctccagaacagttcatataagataggaggaagtatctctatcttaaaggtatggtagaacctagaaaaaaactactgttttttgtttgttgctggggagagtgtagatttttaactactgatttaatttctgtaatgcttacaggtctgtttctgtttcatttctccaattcctagttaactcactccagtctgatttttagttctatgagtatactgaaattccttttatctagcttggtgcctaccgaattctaaacatagacccaaactcaaaggtcacttttcatccttatcctgttcagtggcacctggccttgctggccattcctgccttcctgaaacactcttccttgttatcttccacaggactgccctctcctggctttctgcttctagcttctccatggccccatcttaggccctcttccctttttctctctgtactctcttctctttttttctttcctcctccgcctcctctctaccctcttcttaagtgttctcacccattcccatcattttgaaagctgttatgcttatgactcccaaagttttgtcttcagtgtaaacctctcctgcacactctggatagccaggggcctacttgactctgcccctgggagtattagaagcatctcagcctcaacacagctaaaaccctccttccaccagcataattcctgtcagctaatgggaccctgtcta

SEQ ID NO: 70583 - DNA, 429 bp, Homo sapiens
tttttgaaataaagtctggctctgttgcccagactaaagtgccatgacttgatcatggcttactgcaacctcagcctcctggattcaagcaatcctctcacgtcagccacccaggtagcggggactacagacacatgccaccaaatctggctttttaaaaattttttctagcaatgaggtctcactaagttgtccaggttgggctcaaactcctgggctcaagcagtcctcccacttggcctcccaaagtgctgggattacaagagtgagccactgcactcagcccatactccttttcttaacacttagagcatttcaaggaaaggcaacaattaaaaaaattctttagtttgttacacatgatcttttagacattgtgctaatattggcttattattccaatcctaacactactaatgacagttacga

SEQ ID NO: 70584 - DNA, 2875 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70585 - DNA, 531 bp, Homo sapiens
  misc_feature (475)..(475): n is a, c, g, or t
tcgtacattaaaccctccgtgaagggaaacgggccagaagggcttccaccgctgaggggcagagagcccgtttcttttttaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattaggtgagtcagtgggctttttctcctgcttttgggagtgaatgcaccagggcagagcagagacctggttgctgaatcttcaatccttggctgccccgcaggcttnttgtttttaataaattttattatgttatatgatattttaataattaaaattatata

SEQ ID NO: 70586 - DNA, 1871 bp, Homo sapiens
tgaggccaacgaggcaaaagtttcaaaggttgtcctgtatggggtgttttgtgcgtcttgaataaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70587 - DNA, 1604 bp, Homo sapiens
tagaggacccctcttcgtatgataccaccaggggcgtgctgttcgtggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70588 - DNA, 1575 bp, Homo sapiens
  misc_feature (4)..(4): n is a, c, g, or t
gtgngcgatcccatgagagcgcttttctcacagatggacacttcacagataagtgtcattatgaggtgctgactaccagcgcacctggtgctacagaaacattgtactgcgagctctttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70589 - DNA, 2574 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagaactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70590 - DNA, 1341 bp, Homo sapiens
gttgcagaaaggatgccccgccctgactatagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70591 - DNA, 2337 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagcagggggatcctgctagagtcgtc

SEQ ID NO: 70592 - DNA, 822 bp, Homo sapiens
  misc_feature (22)..(22): n is a, c, g, or t
cgagctcggtaccccggatganggcggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70593 - DNA, 790 bp, Homo sapiens
tgaggccaacgaggcaaaagtttcaaaggttgtcctgtatggggtgttttgtgcgtcttgaataaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgcta

SEQ ID NO: 70594 - DNA, 721 bp, Homo sapiens
  misc_feature (665)..(665): n is a, c, g, or t
tgaggccaacgaggcaaaagtttcaaaggttgtcctgtatggggtgttttgtgcgtcttgaataaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattaggtgagtcagtgggctttttctcctgcttttgggagtgaatgcaccagggcagagcagagacctggttgctgaatcttcaatccttggctgccccgcaggcttnttgtttttaataaattttattatgttatatgatattttaataattaaaattatata

SEQ ID NO: 70595 - DNA, 1319 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttggcgttggtaagtgtttcacctgcttctaaatgttcttcataacatcactttctcttcttttgcaacataaaaaattcactcctttagtttccacatgcatttcagagtccgagtgatctgacttctgactttagacatatggaccatggctgggacctttgctagcccatgtccagcttcacagggggcacatcatgtgtggagtcaa

SEQ ID NO: 70596 - DNA, 1358 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgtgaatggtaatgcaataaagtgcctttgttagatggtgaacttgtg

SEQ ID NO: 70597 - DNA, 839 bp, Homo sapiens
gcggccgctcgcgattggaaccaactcttctacatgtaagaaaggaaaggtattccctgggaagatttcagtgacagtatcagaaacatttgacccagaagagaaacattccatggcctatcaagacttgcatagtgaaattactagcttggtaagtattttccaactttcctttctgtaaagcattctttgttctaacactgagttgcagagtgtagagctggtcttcaggtggttcacgctcgtaccatcgtaccagttgttcaaacagtgaaatgtacctttactggtcggtaaacagcagctgtcctgagcgcctccaccggtgccaccacttcttcattgcccaggcctctcccctgggacccttggaccaccccatggtcttgcacctggaggcgtggcacctggcctggcatggcagagggcctgcagaagctggctccagccataccatacccattgttttataagctattaacacagttttaaatggacagataaatatcatgaagttttaaaataaattatttccacagaatgaaagagaaaaaatttaaagatgttgtttttcttttttatattcaaatttgcataaattttcatactagtctggcttttaaaaaaatgtctagaagaagaattacatctgaatatctgttacttatttttcccattttcaaaaatgttggcatgaacaatagtttcccatcatttagattattgtgagcaagtgcacacatgtgagcaagcatgaaaggaaagggtctttccattctgcagccacagatgttagctctggaaggaccctcagagcatgtccagccaatacagctcaa

SEQ ID NO: 70598 - DNA, 562 bp, Homo sapiens
tccagaagggatgcaccagaactcccttgcaaccattagagtagagttaggaaaatagagacaacttactttcttcaaggtcctcttagcagcctttgtgggggcagtcccagctcagaccctaagaagtctcccagggtccattttctacccagttggatcctgttaaaagctagatagagcattatttttttctgcctcatttgatttgtagaaaatgtgaaaaaaaaattttttttacttgttattaaatctgttttcctccacagtttaaagatgtatttggcacatctgtttatggacagactgtaattcttactgtaaggtaagtttgttatggacaattttggaggcagatgtgtgtctgtctaacttccgagcttctcttgaggtctgcatgtaacattaaggccctctgtggcaagtcacaagttaagaggagagggtcagtctcagtctgagcactgcaaaggggactgtgtgccttggccctgcctctgatgtcaccccaactctgggcagggcatggcctggggaaggcaaaattctgtctgtgattggc

SEQ ID NO: 70599 - DNA, 2255 bp, Homo sapiens
gcggccgctcgcgattggaaccaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70600 - DNA, 1701 bp, Homo sapiens
tgggaactctgacatgctccccacaggggctctttaacactgtttcctattgctcactgtatttcaggtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtg

SEQ ID NO: 70601 - DNA, 1794 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgcta

SEQ ID NO: 70602 - DNA, 351 bp, Homo sapiens
actgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaa

SEQ ID NO: 70603 - DNA, 1004 bp, Homo sapiens
tctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttggggcacttggttttaatgagcttctgtcatttagggcttctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaaacaaaaaaaaaaaaa

SEQ ID NO: 70604 - DNA, 971 bp, Homo sapiens
gcgggtgtgaatcggccgaggctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttggggcacttggttttaatgagcttctgtcatttagggcttctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaaacaaaaaaaaaaaaa

SEQ ID NO: 70605 - DNA, 850 bp, Homo sapiens
ggtggtctagaggatctccttcccaccagcaagactcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttggggcacttggttttaatgagcttctgtcatttagggcttctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaaacaaaaaaaaaaaaa

SEQ ID NO: 70606 - DNA, 819 bp, Homo sapiens
tctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaaacaaaaaaaaaaaaa

SEQ ID NO: 70607 - DNA, 255 bp, Homo sapiens
gatgaatttgtaagagtggtctataaatttaaaaaattagtcctttgagtataatacctcaaaactttatgccagtttgttgtttcaccattgcctttgtttattgtggttttctcagcaggatgttttcacctttacataactgagtttatcaatatttttcttatagcttctggattttatattatgcttcccactctaatgataaaacacacttttctatccaagtgaaattaattttgatataaagactaa

SEQ ID NO: 70608 - DNA, 393 bp, Homo sapiens
ggatttatctgcctattccagacgttcatgtgaaggacaatctgtgggcctttgtgtctgatacggcagagctttgtgctgttgcggcgcacccatgctgcggcagagcttggtgccgtggaggcgcacccttgctgcagcaggcatcagagcacagccctccctgtggcagggtcatgcgggtcatgcacccatcagctgatggacacctgaatggtctctgtttggccctttgcagcgctgctgtgaacacagacctgcgagtgtcgtggagacgtgtgggcatttctcgggcgtacctaggtgtaggtcgctgcactgccttttgtttggagaccagccctttgaagattattgtttcatattctctcttgggaaaacttcttgggtttg

SEQ ID NO: 70609 - DNA, 516 bp, Homo sapiens
ggggacaggaagcagttttcaggcagagaactgaaggagagacaggccaaagaaaggagaagcaaatgaatgcagtagctcagaggagtgccaaaaaggaggtggggaagagaggaaacctccaagagaacacgggctgaaactgaaggcagtctgagttagggatacatcatttaagtgaatagcagaaatgggagacctgcagagtcagagaagggggaggaggctgcttcccgggaaggcagagtcagaagcaagcaggtgaggggagcgcagcaagatctgaggtcgggcaaggggcagagctgagaggcagaaaggtctggaagagaggaaagggtctgaatggtaaacgggaacaagagctgagaaggggaacaggcaagcacggtgcagccaagtccgaggggatcaggggaatgagctggggcacggaagggtcagaaagccagccgaggggcatcccggggtgcagcaggctctgcgagagggcagacaagaaatgcgggtagtagg

SEQ ID NO: 70610 - DNA, 440 bp, Homo sapiens
ctgggagctgtaagtcaaggaggatggagtggagacactgaggtttaggaagaagaaaacacactttgtgtctcctgctcccgatgataataaaatggtaaaagcacatctgtcttgaagacttgaagcacatcaagtcttacttgaaacagtaaaaaaaatggtttccctattcctaaaatacgttccttaatgtctaaatttcctttaatcagggacaaatgtttgatttcataattgaagataggaaactttaaaaagatcattagttaagggaaagaacacaactgtaaaatgtcataatcaaagtgtaagtgagacaccctaccaccatcacactatacacaaaattaatttgaaatgacctaaagtcgtgtaaaagccaacactattaaaacttttaaaagaaaatgggaaaaaattatgaccttgacataggc

SEQ ID NO: 70611 - DNA, 350 bp, Homo sapiens
aaaattcttaatttgcccaccggcctcagggggatctgacttatatctgtctctgcagcctcatctcacaccagacaccccctcactgtgaggatgtcagtcaggttgtctcctacctctgggcctttgcacaggccactctccctgactgtgctaacagctgaaaggaaagattcccataccctgcagacgaggtcaggacctggtattgtgcattcacagagcctggcacattcctccattgctaatggtgggtttacttgtgcagattatttgactggtgcttctctctggcactagactgtaacctgagttggggcaaggctggtgagtggctcaccatagccacc

SEQ ID NO: 70612 - DNA, 417 bp, Homo sapiens
gttggaagagggttttggatatattggataataggtttccttacataagcatgcatgaagtattttattaatgttcagtcatcttgtgtgggcctcactttttacacagccttgtgtgaggcatgatgtccctgttgaacatcagctggacatcacccaagggtcaggtggagacagttggagaccacagcaatagggctttgcattgtggaggggacaagaccgtataatctttgaatcttggggtttaccattagatacgctgatatgtaagactgaaagagacctgagcccctgtgcctggcttctgagaaagtattgggaatgcagcagaacatgacagctaagtgcccagactttgcagctggactgggtttgagttctggatatactcttttctggttggacaacttttta

SEQ ID NO: 70613 - DNA, 449 bp, Homo sapiens
atatccactcctgctctccctcctgcaggtgaccccagccatgaggaccatcgccatccttgctgccattctcctggtggccctgcaggcccaggctgagtcactccaggaaagagctgatgaggctacaacccagaagcagtctggggaagacaaccaggaccttgctatctcctttgcaggaaatggactctctgctcttagaacctcaggttctcaggcaagagccacctgctattgccgaaccggccgttgtgctacccgtgagtccctctccggggtgtgtgaaatcagtggccgcctctacagactctgctgtcgctgagcttcctagatagaaaccaaagcagtgcaagattcagttcaaggtcctgaaaaaagaaaaacattttactctgtgtaccttgtgtctttctaaatttctctctccaaaataaagttcaagcatt

SEQ ID NO: 70614 - DNA, 431 bp, Homo sapiens
tgttctgttttctctttttgtaaactttcactgcagcattatgttgatttgtgttctgtgtctgttttggctcaatttccttacctttccgtttgaatttttttctttgttttcttcaccccatattccaaatgtcattagaccaaaccaacatttgttttgcaaagtgcatattttgacccacacgtgtaaaagccttgttgtgagtgtatgagcctgtatctgtctgctgtgagacacgcatggccaggacagcccgctgtgggtcgcatgcctcgccgctgtccttaatatgaagcaaggttcatattacgccccttctagttcccagttaattaacggctcaagtaatctgcaaacacgtcgtgtttgctaattactgaaactcgaacttagtagcccctcccccagatttcctgtcaaccccttta

SEQ ID NO: 70615 - DNA, 214 bp, Homo sapiens
gtcaggtttattgatgtgtaatttacatctagtaaaattggcacttttatgcgtgtagttctatgaattttaacaaaggcatacagttgtgtaactgtcacctatcaactaaaatattatttgtacttcttaaaaagacttgttggaatcagtaatttatatatgtcagagtcagtgtaaggagttgctcaaatttggaaaaattacaaaaaat

SEQ ID NO: 70616 - DNA, 464 bp, Homo sapiens
tctttttttttttctggagacagaatctggatctgtcacccaggctggagtgcagtggcgcaatcttggcttactgcaacctccgccgcctggggttcaagcgattctcccacctcattctcccgagtagctgagattacaggtgcgtgctaccacgctcgctattttttgtatttttagtagagacagggattcactatgttggccaggctggtcttgaagtcttgacctcagatgatccacctgcctcagcctctcaaagtgctggaattacaggcgtgagccaccgcgccctgcccagtttctgccaatgattatatacttgatatataaacatccttaaatataaaatgttccgtatgattgcacataaaaaatttgttcagcaacgacaatttgtcaacatattaatgtaataaatagtttgaactggaatcacctataaaaaatgataaatcctggaa

SEQ ID NO: 70617 - DNA, 290 bp, Homo sapiens
gttttttcttcctattctcaagttatcaaactcctactcctgctgctgcagtcacttcagatgtcatctctttccctaaggctccttggcaagatggaaggggctccttctgtttgtccccctactgccattcatagctgatgagagggtgctgccttgtgtccacacctctgatttaacactcctcagaatgtgcgacctgtttccctttgagctactctaagccatatgtctcatgcctctgtctagccccaagggccagcagcacagctgcccaaagtagaagttca

SEQ ID NO: 70618 - DNA, 339 bp, Homo sapiens
caaatatcccacgggatatgcttatactaaaaaatattgttatttatgtaaaattcaaattttactgggcatcctgtttcggtttgtttgttgttttcctaaaacccatctctgaatgattgatctggcatatacactaatctcagcaaggcatagccattaacaacagcacagggctgtggaacaagccgtctggtttctaaccctaaccccaccactttcaggccacagaacactgagcaagtcacttaaccttgctgggcctcagttttctcatctgtaaaatagggataatactgaatccccctagtattttcatttatttatttatttttgaga

SEQ ID NO: 70619 - DNA, 4606 bp, Homo sapiens
  misc_feature (508)..(508): n is a, c, g, or t
  misc_feature (557)..(557): n is a, c, g, or t
  misc_feature (1050)..(1050): n is a, c, g, or t
  misc_feature (1062)..(1062): n is a, c, g, or t
  misc_feature (1132)..(1132): n is a, c, g, or t
  misc_feature (1475)..(1475): n is a, c, g, or t
  misc_feature (2297)..(2298): n is a, c, g, or t
  misc_feature (2412)..(2412): n is a, c, g, or t
  misc_feature (3501)..(3501): n is a, c, g, or t
  misc_feature (4307)..(4307): n is a, c, g, or t
  misc_feature (4354)..(4355): n is a, c, g, or t
gcttgcatgtggagcccactaaggcccgaaggggctggcctgcccaagttcacggctctgccgcaagcttgctgcagatcaccatctcctccattcctggccccaactccccttgcatatggagcaaggaaagatcttttgaatgctgaacgggcctgagacaccttcctgaaggaaagctgtccttggatccaggcattgtgaccttgttacttcatttggccttcatgaccacctgtctagggccttcatcaacctcttttacagatgagccctcttggatgataagtaaatggcagcatttggatgtgaccctggtctctctgagcttagctctggactcccctccctcgtgcccctctcaaacaagcaagaagaaggcaggagagtaagttctaatcctggctgtgccactgactccctatgtggtcacaatgaagtcttttccctctcagcacctctgttgctatacctgcacaacgaggagctttgcttggccaggaagagngcacaataggtacagagtgcagatatttctgggcccatagacaaggaanggtgggaggaggggagcaatggtggaccctcttggttgacaaatctaaacaataatatggagcctgagaaagccaaataccagctccccagcttcctctgcagccaggcatggccatctgactgagttcaaactgatgggacattttgtaaaagtcttatgagaggttctagagatgcttttgctttcttgataaagagccatttgcagctggcacttcccctgtcccctccagtcttgaacatggatgcgatgcctggagctatggcagccatcttgcagctgtgaggctcagagagtcccagagataacatttggaacagtgttgagcccctggaccaatacagcagctgcctagctccaggcttcctgttgagtgaggaaaaacaagcaccatgttttcaatgagtagttctgaatgatacaagcagggctggtagacatccccacagttataccaatttttttgccataaacaatattaccatattttntctatttccccnggatacaggggaccaataacaacacaagaggggccaggggcccagggggaaggaaccagatggggagggntgaggactcacgaagttagaagctggggaaggaggctctgcaatagtggaaacaagcgggagccgtaccgtccagtcttaggggtcccgagagtgggcaagggtgtagccaatggagaaggagctggagaagaccattcatggggggggcaggacaaactggtgggatggaggaaggagactgcaaagactgaggctgcaaagcctccccttcgccctcagtggacccactcccacagcccagctgacctccgatgtaggccacagagaagcccctgcgggtggtgctgcggtctgtgtgcagcagaagcagaagctggttgtggcttgaggtcacgggtggnggcaggtggtgtccacaccaattccccagcaggggtgcctcctcgctggccccatcgaaggccgccagatggtcaaagtcacaggtcttggtcaggctgttgggctcctccaggtccaggtccaggaagaacaccttgacctggtagcccgggggcaggcggatggtccagtggcagcggatgttgttggggtaggagctggggtactgtgggctggagaagttgccccgcatggccatgtatacctcctggcattctcctggatgggggatggggaggtggaaggagcaacagtgaggggagaggagaagtcactctctgcagttacagcttaggcagcaggtgccacagtggtccaaaaaccaccagcaggttgtgggcaccatggctagcacaccagacaattgatcccaactatctgaaagttgggatgcttgatcccaaagcttgttttaaactgcaactagctgaaagctgggacttgcattccagttgacagtccccttcacaggtgtaggccctgttaggaattcaataataatacacaatacctgtcctcagagttacctctgaactccctggcttgacagatgatgtggttcatgcctggcctttccccttttctcactgccccatttggtatgtactatgagcataccaaacactctctgccctccaggcctttgcacatgctgttcctcctgcttggaatgcccttcccttctgcttccgtctaactccttcagggtactgctcaattctcttctccacgaagtcatccatgattcttactgatggatagcacagatcataatggcttgnnctgtctgtttccttataatctctctaactagactgtaaagttcccacgacttcatccattcatttgtacgaaaattgagtacctactatgtgccaggtacaaagataagcccanaagggactcagtcagacaggggagattgacatgcaaaccacacacagaagtgacaaatgttagatcatagtgtaaaaaacttatataaggagttgaaaaaaggattaattctggtaaaacagtaagtcttcgcagaggtgacatgcttatgtcttggcataggccaagggtatgctagagcattccaggcagagagagtgcagaaagctcaaggctgcggggggcagaaaggtgtgacccctgcaagtgtaatggggagacaggagcccagtaggcacaggaggattcagggtggagcgccagcccctcctacctgagaagtagtaggccttgaagccacggcctctgatgttgaagtcggacttgaagaccacctgcagttcgtggcccagagacacgagggtggggggcctggtgctgccacagtagtggtgcccacgggtggggccaggccccccaagcacagccacgtagtcataggtgcactcttcattgccctccacctggaagtccacgaacaccagcttgacgtgggcagggccagcggcccggatcacccagtggcactccatgctgttcgggtagttgttggggtactcaggactggtgaggacccctgacaggccagtcaggacgccgccacacacatctgcaagggagcccacttgagctgacctttctttctccttgtggctcccaatttcctcccttgggaacaagacactccaacatgctgcccccacaggtatctcattagggcctcattaccatccagcaagcacctgctacccaagtagcaagtgtagcacgtgctcaggcccagcacttggcacctatgctgcctgttcaaatcctcagagtagccgcacaaggactgtgctgcagtttctctgattttataattaagaaaagggaggcaaagacaagttcagtagcttacttgagtttgagttcacccaggcagaccttgagataaggatttgagtgcaaggagtttacttgggagatccaggggcccccaggtggggagggagggagaggacagagaaggggaggtgtgttcaagtcagctgctgaccttgggggganctctggggacggggtaaagcacatacttcagagttctgtcaatctaggagcaagggagctgcggcatttatatgccaactccccagagtgcaggcagagggctgctgtgggctgggagtgccctactgagacttcagaaaaaagccctccagcatagaactgtggaggttggcagaagcacatcgacgtggcagggcccagggaatgtggtcagggccctgagagcaggtcacccgactggtaactgggaaagtgggatttgaacccaggaagactaactatggatcctgtgcacttgacccttgtgaccttcactgtccactcctacgaggccagtggggcacagaggctgaggtgcctgagctcaggaatgtgatcaaacctccctaatggatgaggaaaccaagacttagagagaggacctgatgaagtagagcttggtttgacatctgaagacaagtagtctcccatctctgccttttattagctgtgtgactctagggaagtaacccagcctctctgagcctcattggaacattagaaatcataagactgaaccagcttgatccactgggctcagacttgagcacagtctgaaaatatgctgctggaaactctcaggaagccagcttggccagtacaactacacggcaagtgtgggtgaatgctgcgacttgctggaggtcaccagcagggaggacatatgtgggatgtgtttcctgagactccagcatctcgccctatggcacggctgtgtgaccagggctctggatggggcatctaaggacttggcgtcttttcccagngctggcccagccatgtaactttaggaaggccctctcagggactcagnntttgtgaaatgagagggcaggtttagatagcctgtgagatcccttccaacactaacaaccttcgcggagacttcccaactgtgccctggggctccccagcagccccctggagcacctgctggcacctggtgcaaatttcattcttatggtgtatttcaagctctcttttaatgtaatgaaaagatagcacccacagactttaatatctttaacaagatattaaaatttaaatattctacatttaaaaattt

SEQ ID NO: 70620 - DNA, 4540 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70621 - DNA, 388 bp, Homo sapiens
acgggtgatacggttacgggtacagcagggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccatcccagcatgtgctgattctacagcacggcagaaatgctg

SEQ ID NO: 70622 - DNA, 4605 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccagggagtggcctctggtggtctgtgacctctgccagtgcagggggtgctgacccgcctggggaaccgtggggccgagcgcgctgtgcttctgctgcaggcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70623 - DNA, 4332 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70624 - DNA, 3794 bp, Homo sapiens
gtcacccctgttgttcccgcaggccccggtgtcacccctgcatttcccatgttcccgatatcacccctgtgttccctgcagtccccagtgtcacccctgcgctccccacggctccgatgtcacccctgcattccccgtgggcctgggcatcacccctgctctccccgcaggcccaggcgtcacccctgcgctccccgtgggcctaggcatcacccctgctctccccgcaggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70625 - DNA, 4535 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacagggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70626 - DNA, 4188 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcagggccacgctgctggcgctcatgggccctggtgtttgcaccgcactttgtaatcagtcccgtggttgtctgtacagaattaaactattttccgatgaaaaaaa

SEQ ID NO: 70627 - DNA, 2345 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70628 - DNA, 1981 bp, Homo sapiens
caaagtgctgggattacaggcgtgagccactgcgcccggctgaacggaactttttaatcttaagagcctagagtccgtttaacactgtcacctggacagttctttgcggtgaatagaagtggagcatccaggcctccccgtgccgtgggaagcacgccgccagctccgcacagtcaagtgatgtttgtgtaaccaccgactatacccctaggatccccaaggaaggagccacccctcggccagtcaccatgtctgcggtgctcctctcacgcccttgtccccttgggctcgggcatcacccctgctctcccctcagacctgggagtcacccctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70629 - DNA, 1467 bp, Homo sapiens
gcctcgtgccgaatcggcacgaggcctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70630 - DNA, 1400 bp, Homo sapiens
caagaggtgtccgctcctagggccctgagcacagcctggcgccccgccacatttgcctgctgctgagacaccaaactgtgctctcttctggttccttcttcccaggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70631 - DNA, 945 bp, Homo sapiens
cttgaggccgggaggcaaaggctgcagagagctgagatcacgccattgcactctggcctgggtgacagagtggagaccctgtctcaaacaaaaaaaagtttctgttcttttctagctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70632 - DNA, 1927 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgaggaatacaacaccaatgtatagaacaccagaaatcatagacttgtattccaacttcccgatcggcgagaagcaggatatctgggtgaggtctggcgcctctcagtggcagtgcctggctccgtgcgccctacttaacctgaggcggcgtgggccgggcacctgccactcggaactggcctgcctcctccaccccctcttcccctcccgtccccttttctttttcctttccttaagaatcactgtggctgccactgtttttttgggtttttttggagacagggtcttcctctgtcacccaggctggagtgcagtggtgtgacctcggctcaggctcaccgcagcctcccgcccctgggctcaagggatcctcccacctcagcctcccgagtagctgggaccacaggtgctcaccaccatgcccggctattattttgtatttttggtagaaggggtggtctcaccatgtcgcccaggccggtctcgaactcctgagctcaagcggtccacctgcctcagcctcccaaagtgctgcgattacaggcttgagccactgcaccctgcccaaccttgactacttctaatagggatgagtcgagtagcagttgggggcgtcctgtgcggctgggtctgcctgaggctcccctcggccccgtccatggcttgttgtgcatctggccctgagtgccttggccc

SEQ ID NO: 70633 - DNA, 975 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggtacgtgtttctgttctgaaggcgagtggcttcacagtagatgagtgatgaggctgagtcatt

SEQ ID NO: 70634 - DNA, 1854 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggtgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70635 - DNA, 4707 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70636 - DNA, 4880 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70637 - DNA, 4233 bp, Homo sapiens
agcctctgcctctcacaacatgtctgccatgcacggagattcactctctcctcacagctctgtggccccagcctctgcctctcgcaagtgcctccgtgtgtttgtgaggctctccattgttaaccttgaaccagtcgggtgagcttgggtggacggcttcctcctcccagataccctcacgtaccctggggttctgggtgtcacagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70638 - DNA, 4590 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacaggtgttcatgtcctccgaatgtcacgttggattattggcgtcggggtgcttgggccgggtgtggcactgt

SEQ ID NO: 70639 - DNA, 4228 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggtgagcagagctgccaggcggccgc

SEQ ID NO: 70640 - DNA, 3590 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaagaggcccctcacccgaaggacag

SEQ ID NO: 70641 - DNA, 2014 bp, Homo sapiens
caaagtgctgggattacaggcgtgagccactgcgcccggctgaacggaactttttaatcttaagagcctagagtccgtttaacactgtcacctggacagttctttgcggtgaatagaagtggagcatccaggcctccccgtgccgtgggaagcacgccgccagctccgcacagtcaagtgatgtttgtgtaaccaccgactatacccctaggatccccaaggaaggagccacccctcggccagtcaccatgtctgcggtgctcctctcacgcccttgtccccttgggctcgggcatcacccctgctctcccctcagacctgggagtcacccctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70642 - DNA, 2004 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgaaaatctgaataaagtatggacatgaaataatcataaaaaaaa

SEQ ID NO: 70643 - DNA, 1200 bp, Homo sapiens
tcaggggaccccccaaacccaaaggaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaa

SEQ ID NO: 70644 - DNA, 1362 bp, Homo sapiens
agtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagaggtgagctgagtggggcctatgctgggggaagctggcccttcccacattccacgccctgagtgcggagtgctgttttccgccggggtgctttgagtctcgctctgtcaccaggctggagtgcagtggtgcaatcccggctcactgcaacctccgcctcctgggttcaagcgattcttctgcctctgcctcccgagtagctggggttacaggcacacaccaccacgcccagctaatttttgtgtttttggtagggacggggtttcaccgtgttggccaggatggtctctatctcttgacgtcatttgtgatccacccgcgtcagcctcccaaagtgctgggattacaggcgtgagcaatgtaataaacagactttattttttagagcagttgaaggtaacaggaagtggagctgaaaacacagggtggccccatccatgccctctcacagcccctccttcctctgagcccctcacgtccttggctctcctccgaagcttcttttcccagag

SEQ ID NO: 70645 - DNA, 390 bp, Homo sapiens
tggccccaggccctgaaacatgaagaccacctggccctgtgtcgtccggagtgggctctatatagttgagggcagggcgtgcagtgggacagtgtctgtgagccgggctgagcccaccccacgtgaccaggcacttcctcagcgtcgtgcctcagtttccgcggtgcagaggaggagggcaggcaggtgcccagggctcggcaagctccgtgtctcccgcagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcac

SEQ ID NO: 70646 - DNA, 2124 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaaca

SEQ ID NO: 70647 - DNA, 1179 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgctacaaactaagaccctacccctaagagcggggtcctc

SEQ ID NO: 70648 - DNA, 2716 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaaca

SEQ ID NO: 70649 - DNA, 2971 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggaggatttaagatttgaa

SEQ ID NO: 70650 - DNA, 2328 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtggtctaacatttaggaagccttgctttgactttatcgggcagcattaagaaatataacaac

SEQ ID NO: 70651 - DNA, 2286 bp, Homo sapiens
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacagaaccgtcgggggatcctcta

SEQ ID NO: 70652 - DNA, 1992 bp, Homo sapiens
  misc_feature (1830)..(1830): n is a, c, g, or t
  misc_feature (1897)..(1897): n is a, c, g, or t
  misc_feature (1912)..(1912): n is a, c, g, or t
  misc_feature (1992)..(1992): n is a, c, g, or t
cggatctgcctcaatgcaatacaacatctaagcgaagagtgagattccaagaaatagacgatagcttggatcacgatgaagttggaggtggctcctgtattttgctggtcttgctgtgcatagcaacggttttcctcagtgttggagggactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatctcctgtcttctgttaggatcatttgaaagatgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctacataactgatatttcngggtatgacaagtattattagatgtcagatatgaattaattctatctaaggtgtttatagagatatntatgtctatataatntaagaattgattcaaatgatgtaaattgtaaatgtgacggactatataagtgtctataaagcttccacagtctactggan

SEQ ID NO: 70653 - DNA, 393 bp, Homo sapiens
actggtatcaagattacactggccttataaaatgagttaggtggctttccctgttttctgttctttgataaactttgtatttattatggaaagcaaaaaatatgcaatacatttgagaagacattaccaaccattactaaagaacataaatgaacatctgattaaaatacagacatacacatgtttatacctaggaagacaatacatttatgaagatttcaattctgacccaatatattctgtaaaactcagtggagctctaatcaaaatcccctcaacttgataaactgatcttaaaattaataggtcaaaacaaatggtcaagaatatctaaaacttattctagttaattttaaaactatagaacactgatatacaaccatataagccaaa

SEQ ID NO: 70654 - DNA, 428 bp, Homo sapiens
cttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaatacatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatatagaactaaa

SEQ ID NO: 70655 - DNA, 189 bp, Homo sapiens
gcggccgcctactactactactactgctcgaattcaagcttctaacgatgtacggggacatgactaatttatcgatttttatcaatttttatcagttttatatttataagccttatttatgatgtatatttaatgttaatattgtgcaaacttatatttaaaacttgcctggtttctaaaccctctgtg

SEQ ID NO: 70656 - DNA, 1865 bp, Homo sapiens
gtgtcacccccagcgggcgcgggccggagcacgggcacccagcatgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggccgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttctaaaccctctgtg

SEQ ID NO: 70657 - DNA, 621 bp, Homo sapiens
  misc_feature (621)..(621): n is a, c, g, or t
ctgtggtccagtgatctccaaaaatgctttgtaacagcagatgattagattttaaaagatcagtttagctggcagtttgcctgttcatctactcccataaattcagtgggtgggcctgactcagtgtgtcggagtagaagctcaggtgaggaaccttaatctaacctgaccaggctgattgacagcagtggagagactgccatacaaccaaaccatggggacacatgaacttctttggaaactggcctgtctgggtcacagtgtgtcctctgcttgttaagaagatgcctggcacagcagtagttagattacttgtaaaatagaaaccttggaatgtctaatgactagattgggaaataagataattggattctagttctgtatttacctccaagctgtattttgatgttgggagactcacttcatttccttgggtatcagttttctcatctgtaaaaggaaatgagtacagtcatttgaaaatacttctagttttattatgttccttgaaatatgggactattggcaccaccccctcacttgaacaatatgagttggcatattaatattaatcttagttaaaagtgttagctgaacaaaatgatagaaacaaaaaaaaan

SEQ ID NO: 70658 - DNA, 193 bp, Homo sapiens
taaatgcctaattggatttctgtctgtctgctatctaatgtttaaaaaaacctaaaattcatttattgattagttgtttaatataattcagagtaatgtgaataggtaataatattaatatgcagtctaaatactgacttttcatcattccataacctggactgatgaaaagtcagtatttagactgcatatt

SEQ ID NO: 70659 - DNA, 1588 bp, Homo sapiens
  misc_feature (183)..(183): n is a, c, g, or t
  misc_feature (281)..(281): n is a, c, g, or t
agtatataagtgtctagcacagtccttggcacatagaaagtgctctgtaaacagtacttcgcatcaaattcttgggatgaatgaaagtgagtgcctggcgctgcacataagaaaagacgtggcagcaaaccatcctcccgacatgacgtgctgcgttggtgcgtttacgtccctgttccttcngaaagactcaaaattgtgttggagctactggtgcacctttgtaagacctgcactaacgaccgcgccactgggaagggcacttctttatgaagtcgccntattcccagggagactggtcaacccatacaatgtgaaaaaaaaagaagctatgtgaaaaaatattcccctttgtcatagagaaggagaacttggtgaggctgggcagctgcaggagcctcagtttttcagataacagaacagagtagaccttgagggtccatttccctttttgttttaggaagtgctgtagaagggggcaaagagatctttgatatgagaaggtatttcttcaaagcagcatcgtgcctgaaatagcattgttctttacgctgagagaggaggaaatgggaatttggtgttcaacgggtttaaagtttcagttacaagaaatggacaagtccgagagctctgctgtgccacatcatgcctaaagtcaccgagactgtgttgtacacttttttgttaaaaggtaaatctcatgttaaatgttgttactacaattaaaaagaagccctaggctgtgtttgcagaaaggcactaaccatacatgtgctcaagagcccttttgtgttttcttcacttcatgttgtagttcaatttagttttgctttgcaaggatcctcggaaagtgtatcatcagcaatgacttttattttagaactaaatgtgaaccacggggggaatcatgatcgacattgctcgttgtcctttcttcctccctgtgggctgtgaatccaactcgtcctgggagcagggcgctctcgccttctgttcctctccgagctcagtgcacagaagcattctgcttacccagctgggactgctgactgcaccatcgagcacgcaggttgcactgttctcagcagctacactggattatatgccgcctttcttactgactgattatgaacttaaaacaaattcactctgctgctgtgaattatacatttatttttaagcatttatttcaactcgagatgagcggtctctcctgtaaatttctccctgctggatctttgctctggtttctggtgacatagtgtgagtgccggcagccgcgagcctcagaaggaaaattacaaagggaatactcagtaaatgatgtattgcctttcgcatcagtagcctgcttggaaatgttcaaattatcagcccaggagactccagtgctgtggacatgggtctgaacgaattgatcacctaggggctactgagaacgcggtgctctgtaagtatccatggatgcacagcgcagacgcggaaagggatccccagaatgttccttctgttgctggtttagattgtgaggaaaaaatgcattttccatgagtctttaacttagtattaaatgttgttactggttgat

SEQ ID NO: 70660 - DNA, 467 bp, Homo sapiens
cgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagt

SEQ ID NO: 70661 - DNA, 305 bp, Homo sapiens
aaaaattcaaaccttactccaagtcttctaatataggagtgattgttttaggagcatttaatattgcagtataagttaaaccactgctgatcagcatccatttacacagggacttatatgcctattgcttacaaagtatgagttaattcctggattcattaacaactctttttcctgtgtttaaaacagcgtgtcttgttatgttgcccaggctggtttcaaactcctggcttaaagcaattctcctgtctgagcctcccagcagtttagagttgtgagccactacacctggccaaccactcttt

SEQ ID NO: 70662 - DNA, 1400 bp, Homo sapiens
  misc_feature (1141)..(1141): n is a, c, g, or t
  misc_feature (1367)..(1367): n is a, c, g, or t
aaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttccttttttttttttttttttttaaaaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagcagaaaaaaaaaaaaaaaaaagatttgcggccttttttttttttttttttgagtatacaccattgnggggatataatttattttggaattttctccattcagcttaaaaggtgtttcttcccaagaaactgaacttttctgtcaaatgcacttgatcgaataggagaattgggttcataaaatggattcattgaaaattttatatataaatcataaacatcagtaaagaagttctttattccatcttcttgtctatgtcatgaagcataataaacctcatatgccccgcggnggacaatgctgacacaaaccactcgttgaacct

SEQ ID NO: 70663 - DNA, 162 bp, Homo sapiens
tcaaactttacccctgctcaagcagtaggtgaaatgaaacatcagttttaaagaaaaaaaaccctgtaattctaagcttctttaaccacatgccactgcccaccacttccccaaagcccttcctttgtttccagggcaggtgacaaccctcactttttctag

SEQ ID NO: 70664 - DNA, 222 bp, Homo sapiens
tcactccgtagtgtgcacttggtgagggcagcagctcgccacagctgccagccgtctgtccattcacccatctgtccatctggcagcccgctgttcagacccgtctgtctgtccgcccatctgtaagcccatctctgtcccattgtctatctgaccatctttctcttactgtcctctttgtctagctatctggcctatctgtcgatccatcttcgtgtctgt

SEQ ID NO: 70665 - DNA, 209 bp, Homo sapiens
aagttgctggtctatgattctttttatttttatgattttattttagtttattttatttttgagacagagtctcgttctgtcacccaggctggagcgcagtggtgtgttctcggctcaccgcaacctccgcctcccaggttcaagcgtttcttgtgcctcagcctcccaggcagttgggattacaggtgagcaccaccactcccggctaa

SEQ ID NO: 70666 - DNA, 338 bp, Homo sapiens
cagcctccacgaagagaaaatggcggaatgggccttcgcctcccttttataacggctgtactcaaccgctgtatcttggaagcttggttttgattgggtgagaaggaacctttttcgacaactcttattggataatagtctcctgctctgactggataatcttaactaatcagagttggagacttatccaatctgtgttgtagtacagagtctgctctcatcctatcagaaagaggcttccagggtatgtcatttgaatacagacattataaaagggaggcaaagatctgcacctgccgtggaggttgggctcatgtgctcctctgcattggagttag

SEQ ID NO: 70667 - DNA, 349 bp, Homo sapiens
tgcctcaccctcctgagtagctgggactacaggcacgtgccaccatatccagctaatttttgtatttttagtagagacgggatttcaacatgttggccagaatggtctcgatctcttgacctcgtgatccacctgctttggcctcccaaagtgctgggattacagacatgagccacagcgcctggcctcctagacattcttaaggaaggaagcaggatgttgatttatattttagtatgagctccttattttactgtgaactactaacagttctcagaccagcacagtgtgggccacagttagagtagcactgtgagtataaatgacagtaaattttagtaacacagtg

SEQ ID NO: 70668 - DNA, 587 bp, Homo sapiens
cacttaaagactggactcagaggaagtgtaatgggtgaacactcaaagcacaggaggagaggtaatgctgttatttcatcagtgacaactctaccatggagacgctgattttagaccttggaagttgtatgggactatcacaggaccatggccaacctttggagtaggcactcctgggtccctggccccatctccatttctactttctgctccctgaagctaaaatctgttgagttcacgatcttcattctgagaagctgggatcttctgcattcatctgtacacagttctttccagtctccctcctgacttcagtgtgctaaaccaggtacctgaggaaggcaggatgcagcaggtttactccatcacatccagatcaataaccattaacattgtgcatagatggagtcctcccagcactctacagagtgggctttgtccctcatctcttctggaagtgctgattaaaaaaaaaattcctgtagatctcaagcccctggattcttagaaaccctctgttccaaacaacccaatctactcactgcccctaactgcctggttcttaaacaagagtgtgtttcaatatc

SEQ ID NO: 70669 - DNA, 826 bp, Homo sapiens
atgtaatatatggctgagtacgggggcgtccatctcttcattatcacatgcatcatctgaagcgggaccgggcaccaaggtactctcgggagagtcagcgggcatggcgggtggagcgctcgaagtcgtacaatcagagacctctgtacgtgactgtcaagttatctctatacaaagatctaacctgtttggattcatatgttaacgatgagttccagggaactaatggaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttgcccattatggatggcccatttagcttaggacaccattacgatcgtcttctaacttttgggtcagttgataactttgaaggcggttgaaagtaaataattgtaccctgtctcatata

SEQ ID NO: 70670 - DNA, 2065 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataaaaaaaaaaaaaaaaaaaaaaaaaaaaaaaaaaaaaaaaaaaaaaaaaaaaacaaaaaaaaaaagaaaaaaaaaaaaacaaaacaaaaaaacagaaagaagaacaacacgacacaaacaacacaataagacgaatcaacggagggagggggcagcgccccggctaccatcacatcgctccggccgcgggcggccccacaccgacccaccaccacacctctgccgagcggacgcacgctacagcgcttcataccaagaccgtcgaggggccggcctaccgacaaaaaactatccgcagcgcgaagagcaagaacaaccactcacaaccacgagccatcagaaggacgacacaccaaccgcgggacggaacagacacgaataacagcgccaccccaaccagaccaaaaagaaccacagcaaaaaaacacaaccaacagggagagcagcaaacacaaacactcaccccgcgccaaacaatgcccagccgagcaaaaaaaatag

SEQ ID NO: 70671 - DNA, 1582 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagttatagaagacatatgggaagccatagaagattgtgacccagtacaaatacagagacctaactgtacgtgaaactgtcaatgttattactctatacaaagatctcaaacctgttttggattcatatgctaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70672 - DNA, 1251 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70673 - DNA, 1057 bp, Homo sapiens
tagacgatcgttaaggcgagccgggtagcaaaggctccttcctccgcgcgttcggacaacacagcagctcagcccgccgatgatgcaggcgcgcggtgctggcccgcctctggtggctgcacgccctattcttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70674 - DNA, 1511 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtttttattaatgcactttctatcctctgtaaactttttgtgctgaatgttgggactgctaaataaaatttgttgcataa

SEQ ID NO: 70675 - DNA, 1680 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagagtactgaggattggtctgagcaggggaagagaagtgggctggtggctgcagttctctgcccacaggcagcattaagatgagtgtaactcttctgtgcctgggtggatcaggagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70676 - DNA, 2393 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagagtactgaggattggtctgagcaggggaagagaagtgggctggtggctgcagttctctgcccacaggcagcattaagatgagtgtaactcttctgtgcctgggtggatcaggaggtacgatcagatttccattggttctttgaggtcataccacctaaattgagatcactgattgtgccacctccattttttatctgttaattttcttagagttatataactttagaccagttttcccacatcaaagtatcaggctgccctttcaagccctcttgtatgaaagttgtctcaagcttaatgctgttgtacagaggaaaatctagtaagcgaagtttggctactgctgtctcttgggtcatggagaacatggttttagggataatagcagccacccttgggatatctgatccagctgtagctggagcctggtcaggtcatgtgctgatcttgcctatctcctctcactgtgggggaatggccaaaccatgtgcctcagaagtggtacaaccacatgaatggctggatataaaccagagacccaagagaggactctttttctgtacaatctcttgcttgagtggcatggcttaggaaaagaaagtgtaggtcaaactcctgagccagatcctgcaatgtaatgctttccctgttgagtaagcctttataatatgcagcttaaaagccacatataatgaggtattcattccaaaggttggcaggtcatgagttagggttcttagatcccatctaggttacaaattgtctattttatgcctgggcctaaatcaaagccattctaaactattcaaacttttctcccctcccagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70677 - DNA, 779 bp, Homo sapiens
catgctgttccagaggatccccagcacatttagtcatcgagacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70678 - DNA, 1133 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctcatgcatatagggacatccatttaggtaacatccattttaggtaacatgcacattaggtcacagacatttag

SEQ ID NO: 70679 - DNA, 597 bp, Homo sapiens
atataatcgaggtcggtaccctgagcagaggtgccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70680 - DNA, 896 bp, Homo sapiens
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttgcccattatggatggcccatttagcttaggacaccattacgatcgtcttctaacttttgggtcagttgataactttgaaggcggttgaaagtaaataattgtaccctgtctcatata

SEQ ID NO: 70681 - DNA, 1081 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagttatagaagacatatgggaagccatagaagattgtgacccagtacaaatacagagacctaactgtacgtgaaactgtcaatgttattactctatacaaagatctcaaacctgttttggattcatatgctaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggagctgctgctaccgtcgctgcagccacggcaggcaccgccaccgctgccagaggagtgggcttgggaaagaagtggtcacctcacttggagctttgctcagaagcatcctcgtcccctgcagccctcccacgggaacgactggataaaagtgagctggtacagaaagccaactcactgagcaggctgagcgctatgatgatatggctgtagtcacgaaaggcagtcacacacgaagcgaggaatgaatccaacgaagagagaaatc

SEQ ID NO: 70682 - DNA, 667 bp, Homo sapiens
aatgacgcggtactttgagggtagaggcgttttagtgcaaatcaaagtaggttggggattcacttaacacaaacagtaaatgtgaacttactgtccccacagacttcagtgccctgaacggttagagaaattaatgaaggagctccaccaggtgccttcacaactctgagtcatatcagaatctctccacagctctcctttcaaaaatgacaccgtgacatttcaggatgtgaaaaaaacttactggaaagtgtgtaagaaaatataaaatactattgtacaatgtgataatgtatcatcagcttgttattttcagtgtgcttccttgtagcgccggactaccatttctgaattttggatttggtattttttttaaagaatcaaactcttaaaagaggaaatgcttataccaatagcctgtatgaagcaaaatttatgtgaaagctaaagatatgcatgcagttaaatatataaataaatctcaatgccatacaaaaaaaaaaaaaaaaaagggcggccgccctttttttttttttttgggggcaaaccttgttttaattgcaaacaacttaatttacagcacattcaataatgaaccaacaggagagttgctgactttgtaacatatgaatatataaaaatcccttgcaattcaggtagtcaaggg

SEQ ID NO: 70683 - DNA, 542 bp, Homo sapiens
tcatattcatccctaaatttgtaccagtatacttataatacattgtacagtggcaataaaataaatttttgttagttctgtggagtcaaatgaagaacaaaactctatgaattttgcaatatgctgctttaactagtgctatttttatatacttgaagcaagaaccttgctgcacatcatgtttaaaaccacttaactctattaaaataaattaattaaatgaaattttcatgattggggtcctacaaagaaaattatcaagctgagttgaaaaccgatgagaaatggctaacctttttctttttactgaaaagcaactctgtagctgacttgaattttttttcattttgtagccacagtcagacttgttggggcttattcaggtcatgattgtggtatttggagatgaacctccagtcttctctcgtcctatttcggcatcctatccgccataccaggcaacggggccaccaaatagtaagtagaattgagattttactttaaaactcatataaacaaaagagaacagaaacctttgtaaa

SEQ ID NO: 70684 - DNA, 1566 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70685 - DNA, 1548 bp, Homo sapiens
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70686 - DNA, 1641 bp, Homo sapiens
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacagatgggattttgccatgttggcccagctggtctcaaactcctggcttcaagcagtccacccaccttggcctcccaaagtgctgggattacagccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70687 - DNA, 1357 bp, Homo sapiens
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacactggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70688 - DNA, 938 bp, Homo sapiens
tcccagtggttacccaggactgggagggtatccggatgggtatggagagattccacctggcatgcctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70689 - DNA, 1957 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcaacttcagtgccctgaacggttagagaaattaatgaaggagctccaccaggtgccttcacaactctgagtcatatcagaatctctccacagctctcctttcaaaaatgacaccgtgacatttcaggatgtgaaaaaaacttactggaaagtgtgtaagaaaatataaaatactattgtacaatgtgataatgtatcatcagcttgttattttcagtgtgcttccttgtagcgccggactaccatttctgaattttggatttggtattttttttaaagaatcaaactcttaaaagaggaaatgcttataccaatagcctgtatgaagcaaaatttatgtgaaagctaaagatatgcatgcagttaaatatataaataaatctcaatgccatacaaaaaaaaaaaaaaaaaagggcggccgccctttttttttttttttgggggcaaaccttgttttaattgcaaacaacttaatttacagcacattcaataatgaaccaacaggagagttgctgactttgtaacatatgaatatataaaaatcccttgcaattcaggtagtcaaggg

SEQ ID NO: 70690 - DNA, 1512 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 70691 - DNA, 1204 bp, Homo sapiens
aatatagaaaagtttgtaaaaaaagaggtggtacggttggaatttcgggatgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacatccaggtctatcacgcccctcgtgc

SEQ ID NO: 70692 - DNA, 1047 bp, Homo sapiens
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggagctgctgctaccgtcgctgcagccacggcaggcaccgccaccgctgccagaggagtgggcttgggaaagaagtggtcacctcacttggagctttgctcagaagcatcctcgtcccctgcagccctcccacgggaacgactggataaaagtgagctggtacagaaagccaactcactgagcaggctgagcgctatgatgatatggctgtagtcacgaaaggcagtcacacacgaagcgaggaatgaatccaacgaagagagaaatc

SEQ ID NO: 70693 - DNA, 870 bp, Homo sapiens
  misc_feature (694)..(694): n is a, c, g, or t
  misc_feature (738)..(738): n is a, c, g, or t
  misc_feature (747)..(747): n is a, c, g, or t
ggttggcctactggaaaaaaaaaaaaaatgagtgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggganataaaaatgcatgattaaaaactaagaataaaaaacctattttnatgtttccnaaaggaaattgtttattctacagactcagtaggtagacacaaacataaagatttccctagaagacatagagtgggatttgataacactgtctgttattttctgtacattgtggtaggtccagg

SEQ ID NO: 70694 - DNA, 711 bp, Homo sapiens
gaaaggaagataagaaggataccactcggcattgtttgcctggatccagtcctgccacaagccaataccaccaccaccctttttttaaaatcaattttatgaccctgaggcaataattcttgccctcctcccatgcatacttttcactacactgatcttaactacctgaaactgagaacatttagataaaaatcagagaatttgaggtcaatttagtagcacagcaaccacatacataaataattgcaaaaaaaagtgatgaagcataaatacaacacactgtcatggtacaaaaaagaaagatcaactcagcttagacggtttatagttcatcagccagaggttggcttattcttttttttaagggacgtagtctataactacatcacagaaaaaacaacatgtaggtgtccccttactcaagaaaggccttgtgacactggaggtaagtttggaagaatatggatctgtcaacctgaggaattgggaaagatgcaaatatggatctgtcaacctgaggaattgggaaagatgcaaatagataaaaacagaactatggtccaacagatgtggtatatttggtatggtggattagatacatccacaaattctttgctgcccatcctagtaagaggcatggcctaattcctctccccttgaaaatacactgacatttagtgacattttattaaatctgtacccttttgtacc

SEQ ID NO: 70695 - DNA, 433 bp, Homo sapiens
agttaagaaactggagttgaagctctaaagtggagtcctaaatttaaatgcctgtgtgacctggtagataccatgaaaatacctgacattgtcagggggtaggagcaccatgacaaagtggaaagggtaggatatgccccaaggagggagctggtccccagaatcggacagctgttgccaggcacgaatgaagtgttgtaagatcttgtctgaaaaatgggaaatatggaaatacagatttttttttttgagacggatcttttaaaacataaagtcgagtgatttttaaagccctgtgctggccaaaccaaacacagttgcagggtatatgttaccctcaggctgtcagattgcaatttctctgtaagagggtgaggtatctgaactatatttactaagacccatttagccagaaatgccttcataattgttt

SEQ ID NO: 70696 - DNA, 1930 bp, Homo sapiens
aaaaaaaaaaaaaaaaaaaaaaaaaacaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacaggggattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaaggatggtcctggtgaatgctgtctacttcaaaggaaagtggaaaactccatttgagaagaaactaaatgggctttatcctttccgtgtaaactcggctcagcgcacacctgtacaagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaa

SEQ ID NO: 70697 - DNA, 2048 bp, Homo sapiens
aaaaaaaaaaaaaaaaaaaaaaaaaacaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacaggggattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaaggatggtcctggtgaatgctgtctacttcaaaggaaagtggaaaactccatttgagaagaaactaaatgggctttatcctttccgtgtaaactcggctcagcgcacacctgtacaagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaaaaaaaaaaaaaaagaagaggaagaagggaagagaaaaaggaagaagaaggaggaaaaaggtggtggggggggtgggacgggaaaggggtttgagaaaaagtggggggggggggggaaa

SEQ ID NO: 70698 - DNA, 1723 bp, Homo sapiens
cagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaatgatggtcctggtgaatgctgtctacttcaaaggaaagtggaaaactccatttgagaagaaactaaatgggctttatcctttccgtgtaaactcggctcagcgcacacctgtacaagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaa

SEQ ID NO: 70699 - DNA, 969 bp, Homo sapiens
  misc_feature (28)..(28): n is a, c, g, or t
  misc_feature (64)..(64): n is a, c, g, or t
  misc_feature (66)..(66): n is a, c, g, or t
  misc_feature (94)..(94): n is a, c, g, or t
  misc_feature (99)..(99): n is a, c, g, or t
  misc_feature (115)..(115): n is a, c, g, or t
  misc_feature (120)..(120): n is a, c, g, or t
  misc_feature (125)..(125): n is a, c, g, or t
  misc_feature (129)..(130): n is a, c, g, or t
  misc_feature (135)..(136): n is a, c, g, or t
  misc_feature (152)..(152): n is a, c, g, or t
  misc_feature (154)..(154): n is a, c, g, or t
  misc_feature (157)..(159): n is a, c, g, or t
  misc_feature (163)..(164): n is a, c, g, or t
  misc_feature (166)..(166): n is a, c, g, or t
  misc_feature (170)..(171): n is a, c, g, or t
  misc_feature (184)..(184): n is a, c, g, or t
  misc_feature (188)..(190): n is a, c, g, or t
  misc_feature (203)..(203): n is a, c, g, or t
gtgaaaaaccaatgacaaacacaacatntgacctgcaatgacaaaattgctgatgatgatggtntngacacacaccccatgccaaataatgatntcacnattgacacatacccanacttntaatnattnngattnntgctcccccaacaatngnctnnncaanncncatnngttgctgatgtgnaatnnnttgtgcttgcttnaaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaa

SEQ ID NO: 70700 - DNA, 955 bp, Homo sapiens
aaaaaaaaaaaaaaaaaaaaaaaaaacaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaa

SEQ ID NO: 70701 - DNA, 391 bp, Homo sapiens
tttgcaagagtcccagcagtctggttaccccattttcctgcaaagatttaatagtggagtacttgcatgaagcctcgtatttcaaagactttacaagtgtggctgctgtatattttattagcatgcaagggggcactgtcaccaactcacttgtcaaaaataaatgaatagagtgcattggcgatgcatttattcattatctatttgacatgtgactgagcctgcagggctggggaagtgataaaagatctcctggttttcacttcaaagaggtgccttctgcactacaactctgtcaggcgttggttgccccaggtgaatatgattaaagtgagggacccaagaaagtgattccattgatggcaccgtggggaggggagaaggtaggctt

SEQ ID NO: 70702 - DNA, 389 bp, Homo sapiens
aggctagtcttgaactcctgggctcaaacgatctgcccgccttggcctcccaacaagtcattttttggggggaaaaaaaaatcagaaataactagttaaggactgggtgtggtggctcacacctgaaatcccatcactttgggaggcataggcaggaggatcacctgaggtcaagagtttgagaccagcctggccaacatggtgaaatcccatctctactaaaaatacaaaaattagctgggcactgggggtggtggtgcgtgcctgtaatcccagctacttgggaggctgaggcaggagaatcgcttgaacctgggaggtggaggttgcactaagcagagattgcgccactgcactccagcctgggcgacagagtgagactccatctc

SEQ ID NO: 70703 - DNA, 3794 bp, Homo sapiens
cgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70704 - DNA, 3674 bp, Homo sapiens
cgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70705 - DNA, 3640 bp, Homo sapiens
cgaaaggccggcctggctgcgacagcctgggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70706 - DNA, 2068 bp, Homo sapiens
cgaaaggccggcctggctgcgacagcctgggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70707 - DNA, 3776 bp, Homo sapiens
cgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70708 - DNA, 3626 bp, Homo sapiens
cgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctactccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 70709 - DNA, 1275 bp, Homo sapiens
  misc_feature (3)..(3): n is a, c, g, or t
  misc_feature (6)..(6): n is a, c, g, or t
  misc_feature (15)..(16): n is a, c, g, or t
atncangtgctctanngtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaaaatgcaaaatcctggtgatgtgttttttgtttttgttttcctgtgagctcaactaagttcacggcaaaatgtcattgttctccctcctacctgtctgtagtgttgtggggtcctcccatggatcatcaaggtgaaacactttggtattctttggcaatcagtgctcctgtaagtcaaatgtgtgctttgtactgctgttgttgaaattgatgttactgtatataactatggaattttgaaaaaaaatttcaaaaagaaaaaaatatatataatttaaaactaaaaaaaaaa

SEQ ID NO: 70710 - DNA, 833 bp, Homo sapiens
  misc_feature (3)..(3): n is a, c, g, or t
  misc_feature (6)..(6): n is a, c, g, or t
  misc_feature (15)..(16): n is a, c, g, or t
  misc_feature (833)..(833): n is a, c, g, or t
atncangtgctctanngtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagttataacatccacgagatttttttttn

SEQ ID NO: 70711 - DNA, 788 bp, Homo sapiens
  misc_feature (3)..(3): n is a, c, g, or t
  misc_feature (6)..(6): n is a, c, g, or t
  misc_feature (15)..(16): n is a, c, g, or t
atncangtgctctanngtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccaggtaagacctctccctttttaaggggagaccaaaagaggaattaagaagagccattatgtcacagctcattaggaacaacccagttttgggaggagacagtggagccgctacagcaacaaccctcccattgtttggggaaataatccagaacgaagaactgtttctcactgtgggtgtaaaggacatttcaggccgtagtggagagggagaaactattgcctgaagcttcaaattttggtta

SEQ ID NO: 70712 - DNA, 1222 bp, Homo sapiens
  misc_feature (3)..(3): n is a, c, g, or t
  misc_feature (6)..(6): n is a, c, g, or t
  misc_feature (15)..(16): n is a, c, g, or t
atncangtgctctanngtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaataagttcacggcaaaatgtcattgttctccctcctacctgtctgtagtgttgtggggtcctcccatggatcatcaaggtgaaacactttggtattctttggcaatcagtgctcctgtaagtcaaatgtgtgctttgtactgctgttgttgaaattgatgttactgtatataactatggaattttgaaaaaaaatttcaaaaagaaaaaaatatatataatttaaaactaaaaaaaaaa

SEQ ID NO: 70713 - DNA, 378 bp, Homo sapiens
tccgggtccttcacctaaggaccaagggctgatcagttctagggaccaatggcccacagtcctgtgcaggatcttcaaagtcttccatctaattgtgccctctctcccccacagcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaatt

SEQ ID NO: 70714 - DNA, 435 bp, Homo sapiens
ccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccaggtaagacctctccctttttaaggggagaccaaaagaggaattaagaagagccattatgtcacagctcattaggaacaaaaccagaactaaaggctcaggtcactgaggctggttcccttgatctttcctgaccccagttttgggaggagacagtggagccgctacagcaacaaccctcccattgtttggggaaataatccagaacgaagaactgtttctcactgtgggtgtaaaggacatttcaggccgtagtggagagggagaaactattgcctgaagc

SEQ ID NO: 70715 - DNA, 541 bp, Homo sapiens
tgctgagattataggcatgagccactgtgcgtggccacatgaccagttttagacaatgagttttgagaacttataatatgtataactttagggctgaacttttacttgataaagtgagaccttctagaattctttttttctgtctgccatgataactagctatgtttcttcaggtggttactaaatgaatgcatgtggagcaatgttccagctgacctgcaatgaacatgtggtttcagtgagaaatatacctctgtcatttaagccgttattgtctgggagttgcttgttatcttagcataatacagcctaacctgactgttaacacagcttaatcttacatcttctttaggtcttgacttacctctaatgttttcctcaaggccttaaggattgcacccatacccaccccatcactctatccccttctctactttatattcctctacaatacctatcttaatataacatcacatagtttgcttgtttattttattattcatctcctcctgccaccagaatgtaagcccatgaaggcagc

SEQ ID NO: 70716 - DNA, 515 bp, Homo sapiens
aattaacatcctagaacaaacactgatgtactccaagaacccaaaacttcccatcagaagatcagcagtcttgtttgccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgttaaaaaaaaa

SEQ ID NO: 70717 - DNA, 559 bp, Homo sapiens
aattaacatcctagaacaaacactgatgtactccaagaacccaaaacttcccatcagaagatcagcagtcttgtttgccttttatcgaagtacatggatcacaatgagctcaggaggatgggtactgactggatagaggacgatctcaggggcttttacctccaacctgtgtttgcctaccgctagatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgttaaaaaaaaa

SEQ ID NO: 70718 - DNA, 265 bp, Homo sapiens
taaaaatttttttttaatttaaattaaaattttttttttgagatgcgatctcgctgttactgtggctggagtgcctattcacagtcacgatcatggtgcactgcctccttgaactcctggtctcaaatgatcctcctggttctgcctcccaagtaactgtgtctgtatttgtgagttaccactcccagctatgtgctgtcttttgatgaacagaactttaattttaatgcagttaaatttatggattatgctttttcagtcttgt

SEQ ID NO: 70719 - DNA, 633 bp, Homo sapiens
ctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctatatagaaagtggtttttgttctttgagtttgttttatttcttgaagattacaataaatatctaagagactatattcctgaaaaaaaaa

SEQ ID NO: 70720 - DNA, 322 bp, Homo sapiens
gctaaaaaaagctagtatacaagtaaaatggaacttatttgtataaaactgttgagaagttatttttaaatcaaaattgattttgaccatttaacactaactttaaacacagagattataaattgatgattattgctttattgttactagggtaacactggtgtaccagttactgggggaaccttagaataattaattattctgttttagttaaaacatttaaatatagggcagagttctaccatttcctaaaataaagttggtctttgaatgaatgactcaattaaacagagctgctttttcaatctaaaacacagccata

SEQ ID NO: 70721 - DNA, 2303 bp, Homo sapiens
  misc_feature (330)..(330): n is a, c, g, or t
  misc_feature (2298)..(2298): n is a, c, g, or t
  misc_feature (2303)..(2303): n is a, c, g, or t
ggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggccncgggcgctgtctacaccccaccccatccctcgctctttgagaagcctctgtgcagtgcccaggtctggcggcccagcttggaagttcctgtggtaccccttgagagccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccntctcn

SEQ ID NO: 70722 - DNA, 1936 bp, Homo sapiens
  misc_feature (1931)..(1931): n is a, c, g, or t
  misc_feature (1936)..(1936): n is a, c, g, or t
ctggtggcctttaatacctggctgttgctgaaaggtctttagaaacggcgctaacagcaggtttgtggaatgccggatcgctcaacggcctgacgtgggcaaaaacctcgccttccgcacccatcattatattgatgctcattgccgccgccttactggtacgccggatgcgcttgctggaaatgggacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccntctcn

SEQ ID NO: 70723 - DNA, 1860 bp, Homo sapiens
  misc_feature (3)..(3): n is a, c, g, or t
  misc_feature (1855)..(1855): n is a, c, g, or t
  misc_feature (1860)..(1860): n is a, c, g, or t
ccncctgtgcactcattacctgcttcctgagctccccgagaagtcatccaggacctccccgagaagccgtccaggaaacatgctctcaggggacccccatctgcctcagcctctttgtcactgcctggaccattgtccctgctgtttctcaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccntctcn

SEQ ID NO: 70724 - DNA, 2249 bp, Homo sapiens
  misc_feature (330)..(330): n is a, c, g, or t
  misc_feature (2244)..(2244): n is a, c, g, or t
  misc_feature (2249)..(2249): n is a, c, g, or t
ggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggccncgggcgctgtctacaccccaccccatccctcgctctttgagaagcctctgtgcagtgcccaggtctggcggcccagcttggaagttcctgtggtaccccttgagagccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccntctcn

SEQ ID NO: 70725 - DNA, 2099 bp, Homo sapiens
  misc_feature (330)..(330): n is a, c, g, or t
  misc_feature (2094)..(2094): n is a, c, g, or t
  misc_feature (2099)..(2099): n is a, c, g, or t
ggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggccncgggcgctgtctacaccccaccccatccctcgctctttgagaagcctctgtgcagtgcccaggtctggcggcccagcttggaagttcctgtggtaccccttgagagccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccntctcn

SEQ ID NO: 70726 - DNA, 943 bp, Homo sapiens
  misc_feature (673)..(673): n is a, c, g, or t
  misc_feature (806)..(806): n is a, c, g, or t
tttaactaacacatattttatgcattagaaattatatttggttattttttcaggaagtgtattttttacattatttaattcctcagttaattaatttttacatttggctcttttctgatacattcaagaagaaatatatatattcctcatagtaaatcttaggccttgtatttccaaggtcttactgtgatttttaccttgaataattactgatatttcttcatggtttaatttttgtgtatttctgtgaagagcagccttggttttggatgccatgaaaggtttattatattgcacctactttatatttttaatcattcatattgattgataatctgtccattgcagaaatgaggagtttccaaaaagtttatggaaatatgtattataaaaaaaactatgcataaatttcaactttttgcacaaaaataaatggtatactagcttgttataacatgtctaaacaggatccagttgaaggcactgagaagaataagacatcagtttgaaaagagcctctattaaagcaacttgaattatgctaaaattgaagtaagaacaaacatcaaatgtatggtgaagcttgggtagaagaatggtataattgctgatgctctacaaaaagtttatggggataatgtcacaaagaaatgagcagtttacggccaggcanagtggcttgcacctgtaatcctggcactttgggaggccgaggcaggcggatcacgaagtcaagtgattgagaccagccttgccaacataatgaaaccccgcctctactaaaaatacaaaaaattagccgggcntagtggcgggcgcctgtagtcccagctactcgggaggctgaggcaggagaatggcgtgaacccgggaggcggagcttgcagtgagccgagatcccgccactgcactccagcctgggcgacagagcagactccgtctc

SEQ ID NO: 70727 - DNA, 2121 bp, Homo sapiens
ggttagattatgttgaaacacatctgtgtttcagatgtgttcagagctgaggtctcagctgaggctccactgaagcaggattcacttccaaaataacagagttgttgccaatattcagttcgtagcaaactactggaacaagaatctgttttcttgctgagtgaatttcttgccatgtggccctctccaaatgctggacataaaaaagtaggctgagcacagtggcgcacacctgtagtcccagcggtttgggaagccaaagtaggaggatcgcttgaggccaggagttcaaaactagcctgggcaatatagggagacccccatctctacaataaataaaaataaaagctttcatttacaatgatggtagaccaagaaatttgtcctagatcttcactgagaacatctagaaaagctggcagctgaacaaaattttaaaaacatctgggctgggcacggtggctcacacctttaatcccagcactttgggaggcaaggctaggggatcacttgagctcaggagtttgagaacagcctcagcaacatagggagaccccatctcttaaaaaaaaaaagataaactaaaaataaattaattaaaaacacctggttgaagacatcagcgagctggcaacaatgaagaattcctaaggaaacagaaactttgttaggggagctgttttcccttgtgttggccaattctgcgagtggtaagtgattgctgagctgttgaatggccattttgacaaccttatgggacaaggaagaaggggcctgcactggtaaaccctttcccttacttggagtgaggatcccaaatggctactcattaggagtaacagtggtccagaagtaagcaggccttcaaagggatggcagctcagcttcaaataccctcagtttctgaaattagattgaggttatctaaggtttttagagctctcagatgcatggcagaagcaaatctacatttgcttttcaggaagaaattaacatcctaggtgtggcagacagactctaaggtggccactatgatccctgtcccctggtattccttgtgtggagggagactcccatgacttgattctaatccatagactaccacgaagatgatgagatggacatgattacagcaaattctaatgttcatcttattaagagactcttgttgactttgaagaagcaagctgccatgatgtaaaccagcctttggagagggcctcatggcaagaaactaagggtggcctctagccagtagtcagcaagaaaacagatccttgttctagtagtgtgccaggaactgaagattgccaacaaccttgttattttggaagtgaatcctggttcagtggagccctagctgagaccttagctctggctaacaccttgattgcagtcttttgagaccaggaaacagaaagaagccagctaatctgtgcttggactcctgacccacagaacctgtgagataataaatgtgtcttgttcttaacacaccagatttgtggtaatattgttacacagtgtagaaaactaacaaactaggcctcaaaataaatctataaacagttttgcaggtacactgtagaacacacaataaaaagtagccacagaaagagacatgagtgaataccagcaggagcttctatttaaacatctgtagggacctccagatattggagttttcagagacaagcttaaaaaaaaaaagaaaaagaaaattaaacttacaagaattttggcaaagaactgaaaattatattaaaaacaaaatgaaacagctagatgggggggataagttctagcattcttctgcactgtaggatgactatagttaataatatatatttccaaatagaggatattgaatgttcccaacacaaatgagaaatgttttgagttgaagaatatgctgatttccctgatctaatcactgtgcagtaaatgtatcaacatatcaccatatatgccataaatatgtacaattattttgtgtcaatttaaaaaaaattttaaaggaaacactagaactgaaaattagcatgcttgaaattaggagactgatggatagaattgacagaacaggcatagctgaagaaagaattggtgaatgaacacaaa

SEQ ID NO: 70728 - DNA, 405 bp, Homo sapiens
ttttgacaattactgctgtctctgagcctgaccccaacaatatgactggctttttggaaaactgggtattttccttctcagtatagtgcattggcatacagtgctttttatcagtgtccattcatgccatgacatcctacctgcttcagctggaactctgaatgcttatgaggcaagagtactgaattggggaagtttggagacctaggtttaatcccctcctttgtgtcagttgtgttattgtgggggaaagcactgacctagtatccagaagatatgaggttaaatcacaggagaatttatttttattttaaactatacagacagagtctgttaaagggaattaaacaaattaatgagtatatgtgtctacacatgcaggtacaccaacaaacacttgtcagt

SEQ ID NO: 70729 - DNA, 391 bp, Homo sapiens
  misc_feature (58)..(58): n is a, c, g, or t
  misc_feature (60)..(60): n is a, c, g, or t
agcaaattcctttcttattggggagaagatttggatattaaatatatatatatttttntnacggagtctcactctgtcaccaggctggagtgcagtggcgtgatctcagctcactgcaacctccgactccctggttcaagtgattctcctgcctcagcctcccgagtagatgggattacaggcatgtgccaccacgcccagctaatttttgtatttttagtaaagacggggtttcaccatgttggccaggatggtctcaatctcctgacctcgtgatctgcctgctttggcctcccaaagtgctgggattacaggtatgagccaccacgcccagcctccagcactttctaatgctgtccctacatgcagtggcagctctacccttacaggg

SEQ ID NO: 70730 - DNA, 618 bp, Homo sapiens
tacttgtccaatggaaagtgtattggctcccttaggggagagaacccctatgttctaggttcttcacatttggtaacttgaaagagtttacttaatatcccaggggcttagcctccccccttgtaaaatgtagaaacaggctgactgttttcttatgagatacagcaagagaatgagaaatgcggtcagtataaccatcttcaaggaaccagtgctagacatggaaacctgtcttgatgctcaccaggagttgccccattcactatccatacctgcttctgaagggtggcccagatattatagtacaagttagtttgtacactgtttctatatttctcagaatgagggagtccttgaattcagcctttagttcctaacagtagtatcctcatagttaatttagaaggttcacaaagagataatatccccacttgatagttggtgaatctaagacacagaaaagtcaagatcacacagccagtgggacaggaattcaagtacctttcacttctccaggtttttttttttttttccgctgtggtgccattttctatgttttcccgctttttttgtatttttaacaacaattttattgaaatataattcaccctttaaagt

SEQ ID NO: 70731 - DNA, 591 bp, Homo sapiens
ggcagatacttttataattgaatcataggcctggagggtcagtcttttccctcataatacagatgagaaaatggtgagccttttaaaaagttaaaatcttggtatcagtttgtttgtgaaaacatctgtcttggaaccatttcaaaatttccttaatcacttactcaggtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggtaagtcaaagatacttgctttaaagacataatgttttctataacttgatccataataattgtaaccctttttagggccaggtacaaaggctcatgcctgtaatcccagcactttctgaggctgaggtgggtggatcatctgaggtcaggagtttgagtccagcctggccaacatgggtgaaaccctgtctctactaaaaaaaatacaaaaaaaagacaaaaacagttagctgggcatggtggtgtgtgcctgtagtctcagctactcgggatg

SEQ ID NO: 70732 - DNA, 8330 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctctttaacatagcttatagtaattgatattttcttagaataagtacagagcaatatatcattaaagggctatgaaggggcaaaagaaatcacaccataaaagttagtactttttcccaatctgaaatgtcagatagagctagaagtcagatatttaggctgtttaaactttctgagagtttaatcaaaaggtgtgtatttctagaaggatgactagaaaaatgatgtgtggttgcttctgaatgggaaacaggagtcagagctgacaggaaaacttagagtggctataacatttttaaaataatcttttgagttgtaaaatagtaaatcacacattccaacttttccatagaaaggaaaacatgtaaacaggtaagaactaagtattcttaattaaatgacccagtcattgtagtacatcttaagaataatgaagagatgtggagaattgaactgagtaatgaatgatattaaagaactgctgtcaatttcatggatgtgatgatttggtagttttttcaatgtatgggtgtgggaagtcaaacaagcatgatagaatgttaactattttaaactgggaattgggttcatagatatccattgtactacttcccttggtttttgtgtctttatgataggaaatagcaaactgttaaaaatatagattcagagattattagtcttatcatttgggtttcttgtaggaaaatcttaacatttgggggcctgggtataatttttgtttcatatattcactcatatatatgcttattgtatatgcttatttattctacaaacatttctccaaaaagtattctagtgaaagggtaaaagtctttgatgttgggactgattgaactggtatagccttattccttctggatggtttatatgaacttacttattcaaaagtaaatattccactg

SEQ ID NO: 70733 - DNA, 8458 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctctttaacatagcttatagtaattgatattttcttagaataagtacagagcaatatatcattaaagggctatgaaggggcaaaagaaatcacaccataaaagttagtactttttcccaatctgaaatgtcagatagagctagaagtcagatatttaggctgtttaaactttctgagagtttaatcaaaaggtgtgtatttctagaaggatgactagaaaaatgatgtgtggttgcttctgaatgggaaacaggagtcagagctgacaggaaaacttagagtggctataacatttttaaaataatcttttgagttgtaaaatagtaaatcacacattccaacttttccatagaaaggaaaacatgtaaacaggtaagaactaagtattcttaattaaatgacccagtcattgtagtacatcttaagaataatgaagagatgtggagaattgaactgagtaatgaatgatattaaagaactgctgtcaatttcatggatgtgatgatttggtagttttttcaatgtatgggtgtgggaagtcaaacaagcatgatagaatgttaactattttaaactgggaattgggttcatagatatccattgtactacttcccttggtttttgtgtctttatgataggaaatagcaaactgttaaaaatatagattcagagattattagtcttatcatttgggtttcttgtaggaaaatcttaacatttgggggcctgggtataatttttgtttcatatattcactcatatatatgcttattgtatatgcttatttattctacaaacatttctccaaaaagtattctagtgaaagggtaaaagtctttgatgttgggactgattgaactggtatagccttattccttctggatggtttatatgaacttacttattcaaaagtaaatattccactg

SEQ ID NO: 70734 - DNA, 8404 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctctttaacatagcttatagtaattgatattttcttagaataagtacagagcaatatatcattaaagggctatgaaggggcaaaagaaatcacaccataaaagttagtactttttcccaatctgaaatgtcagatagagctagaagtcagatatttaggctgtttaaactttctgagagtttaatcaaaaggtgtgtatttctagaaggatgactagaaaaatgatgtgtggttgcttctgaatgggaaacaggagtcagagctgacaggaaaacttagagtggctataacatttttaaaataatcttttgagttgtaaaatagtaaatcacacattccaacttttccatagaaaggaaaacatgtaaacaggtaagaactaagtattcttaattaaatgacccagtcattgtagtacatcttaagaataatgaagagatgtggagaattgaactgagtaatgaatgatattaaagaactgctgtcaatttcatggatgtgatgatttggtagttttttcaatgtatgggtgtgggaagtcaaacaagcatgatagaatgttaactattttaaactgggaattgggttcatagatatccattgtactacttcccttggtttttgtgtctttatgataggaaatagcaaactgttaaaaatatagattcagagattattagtcttatcatttgggtttcttgtaggaaaatcttaacatttgggggcctgggtataatttttgtttcatatattcactcatatatatgcttattgtatatgcttatttattctacaaacatttctccaaaaagtattctagtgaaagggtaaaagtctttgatgttgggactgattgaactggtatagccttattccttctggatggtttatatgaacttacttattcaaaagtaaatattccactg

SEQ ID NO: 70735 - DNA, 3993 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctatatttcacagagctcaaaagatggatgaagatcaaatcagtagaaactctggttcaaaaatactgaagatt

SEQ ID NO: 70736 - DNA, 2172 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagctactcgggaggctgaggcacaagaattgcttgaacctgggaggcagaggctgcagtgagccgagattgcaccactgccaagcctggataacagagcaagaccctgtctcag

SEQ ID NO: 70737 - DNA, 364 bp, Homo sapiens
agtaaatttgtatttctctgttctggctaccttgcgcaaacaatatttttgtatacgtaacttttattttataatttttaaggtgttgatatatttaaggagtgcaaattgggatacccggattgcagcaggacaagctgttgaagctatagtgaaaaatgtacctgagtggaatccagtgccgagaaccagacaaggtgcttttaagtggagaaagtagttttaagtaaaaacctaactgtagaattaattataatatgcgttttgtattttaataatttcaattttaaagtcttaatttccatgcttttaggtacagctttgtcaggaaatgatactgaataaggtgatttttcaccacatt

SEQ ID NO: 70738 - DNA, 346 bp, Homo sapiens
gccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtatcctttttcatttgacaaactgttcaggaattatattcatttcacttaaggataattaaaatgaaattgatgtgttctaatatgcacataaataacctgccttgttccaaaaaatacctattctttttacatcttattttgaaatatttttgtattttattacaaatgtgtt

SEQ ID NO: 70739 - DNA, 710 bp, Homo sapiens
tatggtacagtcatacaacaaaagagtgtgaacctgtcaaaaaagaatgtgatcgatgtatatatactgaaatttatagacttggtcttcttctgaggctgagactataggtacttattttaatttcaaaagttccaactcagcattcttttattcttttagactcttcaggcagctgaattgattgactcagagtttcgagcaggaatgagcaatagacaaaagaacaaagctaaaagaatggccaagttatttgcaaaacagagatccagggatgcagtggaaactaatgagaagaggtagtaatctttttttgcctattcacttaaaacaagagggctctgtggctttaatctgtgtctgcttgatttatagaaacattctgctgacatatttagctggggagtactgtttggattctcttactcaattgtcagagagtattcattgtactaggaactgagaccacttccccagaaaaatccacatgtacagacttttttcctactaattatcagttttgaatgagggctgaggatctccaaaggggagagcattccaggcagaagaaacaagtttaaatgccttaaacatggaataatcaagaaacaaatagaagggcagtatggccttctatactgggatgagtgcacaggagagtgatagagaatgaaatcagagaggtgtctaaggaccacaagttaagaata

SEQ ID NO: 70740 - DNA, 7221 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgta

SEQ ID NO: 70741 - DNA, 8404 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctggtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctctttaacatagcttatagtaattgatattttcttagaataagtacagagcaatatatcattaaagggctatgaaggggcaaaagaaatcacaccataaaagttagtactttttcccaatctgaaatgtcagatagagctagaagtcagatatttaggctgtttaaactttctgagagtttaatcaaaaggtgtgtatttctagaaggatgactagaaaaatgatgtgtggttgcttctgaatgggaaacaggagtcagagctgacaggaaaacttagagtggctataacatttttaaaataatcttttgagttgtaaaatagtaaatcacacattccaacttttccatagaaaggaaaacatgtaaacaggtaagaactaagtattcttaattaaatgacccagtcattgtagtacatcttaagaataatgaagagatgtggagaattgaactgagtaatgaatgatattaaagaactgctgtcaatttcatggatgtgatgatttggtagttttttcaatgtatgggtgtgggaagtcaaacaagcatgatagaatgttaactattttaaactgggaattgggttcatagatatccattgtactacttcccttggtttttgtgtctttatgataggaaatagcaaactgttaaaaatatagattcagagattattagtcttatcatttgggtttcttgtaggaaaatcttaacatttgggggcctgggtataatttttgtttcatatattcactcatatatatgcttattgtatatgcttatttattctacaaacatttctccaaaaagtattctagtgaaagggtaaaagtctttgatgttgggactgattgaactggtatagccttattccttctggatggtttatatgaacttacttattcaaaagtaaatattccactg

SEQ ID NO: 70742 - DNA, 4344 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggtaagtcaaagatacttgctttaaagacataatgttttctataacttgatccataataattgtaaccctttttagggccaggtacaaaggctcatgcctgtaatcccagcactttctgaggctgaggtgggtggatcatctgaggtcaggagtttgagtccagcctggccaacatgggtgaaaccctgtctctactaaaaaaaatacaaaaaaaagacaaaaacagttagctgggcatggtggtgtgtgcctgtagtctcagctactcgggatg

SEQ ID NO: 70743 - DNA, 2648 bp, Homo sapiens
agcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagtgagtgtacattaagtgtcaggtagtcatacatttacaagtctggctttcaaaggttatttaaccaacagaagattcctctgctgtctccatcagtccttccttccttcatcacactaattatagcctaaggaaaaattagagtaagcaaatacttctaattattttaaagctttaaaataggatttat

SEQ ID NO: 70744 - DNA, 536 bp, Homo sapiens
ggctgaggcaggagaatcgcttgaacctgggaggtggaggttgaagtgagctgagatcatgccactgcagcactccagcctgggcgacaggagcgaaactccatctcaaaaaaaaaaaaagaaagaaagaaaagaaaagaaaatagggctgttggattagataaaatcatgggctgaagtgcttaatgcagtatttcacacaaagtgctcaatacatagcggtcacgctgatgaggatgatgtgatgatgaggaatgtgggcatgtatgtctgcctcagagccgttcgttttagcactagctggtggtgtcaccagctctagctgcctccatcaactagtaggatttgaggaaatattggggaaagcaagacagaaacttcttgacacccctcagaggtaactgggttaatattctgcagagaagacgttagcttggtcctggcttttctgacagcagcggagggtgatggggacttttaaaaaagagcccagcactgccagcgctttgggaggatcgcttgaggccaggagtttg

SEQ ID NO: 70745 - DNA, 549 bp, Homo sapiens
cctgcctcagcctcctgagtagctaggactataggcacatgctaccacgcctggctaagtttttgtatttttagtagagatggggtttcacagtgttagccaggatggtctccatctgacctcatgatccgcccgtctgagcctccgaaagtgttgggattacaggcgtgagctactgcaccaggccagttctggtcatcttacaagcgttgtttttcaaccttcctatctcattctcttcctgctaaatgtatatgttttgttgattaaaggaaataagacttatctcccaaatttactgtcaagacatttgcaaagtaactgcagtaatagagtttaaccttggaaaatgttggttactgagaattattgatatcttaaccaaattaagctgttcatttccttggtttaatgagaacgtctcaatatgcttaagaatattcttttctgatttctttcaaattataggtatttttttcttttcttttttcttttttttttttttgagacggaatttcacccttgttgcccaggctggagtacagtggc

SEQ ID NO: 70746 - DNA, 442 bp, Homo sapiens
attggtttcctggggctgccataacaaagttccacaaactggatggcttaaaacaacagagatttgtgctctcatggttcaagaagccagaagtctgaaatcaaggtgtcagcagggctggttccttccaggagtctctgaaagagaaactgtcccacatacctcttttcttagcttctgctggtgtctggcaatccttggcactcctcgacttgtagctgcatcattacagtctctgcctccgttgtcatatggcctttgtgtctctgtatctaaatcttttcttttatcaagcaacagccattggatttagggccccacccccaacatagtatgatctcatcttaaatttgatgacatctacaaagttcctatttccaaataaggccatatttacaggtaccaggagttaaaacttcagcctatctttggagaagacaca

SEQ ID NO: 70747 - DNA, 510 bp, Homo sapiens
attctaaaaaggaacccctgaaggcttatgtaatagcttatttgatccacataaaaagcgagataggaaatcaagtttctgctagttagacaaaagctattttccttcattaaaatgagtgatgagaacaaaaatcaagaaaagacccttagaacaaatagagcctcaaataccactttggcagagtacagttatgctaagctagaactttaaatagcaacactctgcatacttttggcttaccccattgaaatcactatgagctattgttttattgtctgctgttacatgtaagttgctggcagctgctgatggtgattgctgcttggggaagaggaactggaaagaaagatcccttaccaactgttttccatgctgcccagatgtgaaaggctccactgccctagaaggataatggaggagttgaacattatcaaaaaaaatgatattttagaagctaggagctgaagtatcctcaaattaggagcctttctccatttattttcttag

SEQ ID NO: 70748 - DNA, 771 bp, Homo sapiens
cacatataaaaacactgtgtaattctaaaccgctatgcaaacctaaggtataatctcactttataatttgtgaaagtttactaattgttttacttttcttggcagagtgtctgaagatctactggaaagttataagtgtatttattttattttcaggggtgtcatcacactttgagctgctgtgacagtttactgctggaataactccatcccaaaattattactgtaaattgaagtcctatttttctgccccaagtgtattcttaatattaacagttggtaattagtctgtcctttggagagactctgaacagttttgaagagcatcctgcacgtttaatcagaacacttcaagccagacaatgaaatgtaacattcagtaaactgtgatagtgttcactaattgctgatgctatctctattgtgttacgtttaagttatattctttaatattttaagaatccttttatttatttatttatttatttatattttgctgtaattctttttaaaaactacaagacatttatagatgcaaaagtaaagagtaagttaatagaacactgttctgttttagagatcaatatatatgaaatgtttctcttggaaactgctaaaccaacaggtcatttattattataatattcacttgcctttcctcatttggatgatgtaaaaatgatcattattttgctactttatgccaatctgggtaactgcattccatatttagagagcatgttttggatttaagcagcttaaactactaga

SEQ ID NO: 70749 - DNA, 797 bp, Homo sapiens
tccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtaccgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtggggaagtgtcctgagaaaagtgttattaggtgattttctttctttttttggtggtgggggggttgcgtgaatgcctaggctgtatggtatatcctatagcaccttgctacaaacttgtatagcatattactg

SEQ ID NO: 70750 - DNA, 424 bp, Homo sapiens
tgaccagtttcacttcttgccagtacttcccttgtgctgttttcctgtagcaacaaaacggaaactgagtttttgcagcctcagggtgcagattttagatctggttctggaagtcaaatagaggcctgaaatacagcttaacacatacacgcacacatacacgcacacacaaacacacacagagacacagacacatatatacacacatatatacatatgtacacacatatttacatatatacacacacacactgtcttgcaaaaagatattacattgttaaagctataatatctctgagaaaaatttaagagaagttccatagagggttaagtcctgttcatttttattcaacatcattcattaagtttattttttcagttttctggattgaaatttatttttgcttctatctaatatatatct

SEQ ID NO: 70751 - DNA, 192 bp, Homo sapiens
ggaccttgggcgagttgtcaaggctctctgaatattagtttcatcctttaaaaacctcggattatcacacctacttgataggctgacgtgagtgccacatgaggtcattcccacatagggagtgggcactgctaggcacacaggcagtgattgctgtcattctggaggttttagagcactgctgattgctgg

SEQ ID NO: 70752 - DNA, 642 bp, Homo sapiens
aatgaataatcagggtcactagatcaagtaacacaggcaagaatacatgttacttgataccttcaatgagatctctgccttctaagaatttttggtttaatagcattaaatttaaataacgccaactatattgtaacaagcacaatgaagggaacccctagcccagagtagggaatcaggaatgaggagagctgctaacaggaaactttccagagcaggctagacctcagctgaatcttcacaattaagtagtagctgactcaaccttgtttcatgaaacaaggctcccagtattctgctctatacactgagcttactatgttaagtaagactacataacagtgataacaaattattgaaatttcctatataaattttgtaaactggatttgttacttatcctacatcttaaaaactgaagatattcttagttcctactatgcaacacagtacactgtacctaaaatgcacaaaatgactgttgtagaaaagagccgtatccactgacattacaaaagagtaatcaataaatttcaaatgccaaaccctttttatggtggtccaaaaggaacagtgctagatgaatctagttaaattaccctctagaacagtgctgtccaatctgaagtggaatgtaaacca

SEQ ID NO: 70753 - DNA, 477 bp, Homo sapiens
ttcggactatttattccagttgcaatggggaaaaataaaggagtttttagacctcccatcccgtttacctccactcaccacttgtcagccagccaggatccgtagaatctgcttcacaaggcagcccactgtgtctgggtcctgcagtgattattacagaaaaggaaaggaaaggactgaagtccttttggaggatgaggccttgttgaatggggactgttgtaaggtgagggacggtctctgggtatgggactagggtctggtggtgtggactgtgtacccactagagccctgtagtggggaggggttacaaagccaggtaaacagcagtcctaggaaggaagaggcagataaaaaggtggataatgcatgcatttgttcttcaatgaattgtgtgtgtgtgtgtgtgacggactctcactctgttgcccaggctggagtgcagtggcgctatctcggctcactgcaacctctgcc

SEQ ID NO: 70754 - DNA, 413 bp, Homo sapiens
gtcggggatgttttcctctctgaagaggagttgcagtgagggctttacaggaaagttggccttccagctgtgtactaatggatacatagaaccttgccatttgtaccaagtggagaagaaccatcctaagcagaaggagcagcaggagcacactcatacaggcatgaaacaatataccatgtttagggacataaaagtagtttcctatttctaggtgataaagcaaaatggagagagctccagaatctcaagctaaagaggtgcttaaaacttatattaagagtaaatttttatgcttataaacatcatcagattattcactcatttgttcatgcatgcaagcatgcattcaaaaattttgtgactatttactacatatctgtctctttgacaggtcctttggcttccctggg

SEQ ID NO: 70755 - DNA, 468 bp, Homo sapiens
gggagacatcagctggatattgagatggaaggatgactatgagtatgagctattatagaaaccatggaatctttggccatctatgaaacaatttccatgggaaaatgacttgtttggactgtattttcacaaagctgatatttctggcccttagaatatgatacctgtttgtctaaaaaacatatatctattcagataggacaaaattccttttcactgcagtattgggagcctggaactagagttaccaacccctctgcgttaaagaaggagctgtcctgaggcttccatctctactgggcttgaggcaagaacattgttagggacggcctgctcttggcctctgtgccccagggattgcaaatgcatgttcctcaaaggtaagggctgtatcattcggctttctttgtattcacaggtacagcttgtgctaggcagccggtgttcaataaatatcgtgcctaagga

SEQ ID NO: 70756 - DNA, 483 bp, Homo sapiens
ggctaaacaatatatttatatgatcctcttagccctgccattctgtaattctttcaggaattttgtcattttggatttgcttgtctcataaaacaatgtgtagttgcttaaaaatcaactattctatttggttgacttggtctaaagtatttctcatgttgtctcgtcattcttttgactgttccttttttttttttttgccttggccagataggacaaaattccttttcactgcagtattgggagcctggaactagagttaccaacccctctgcgttaaagaaggagctgtcctgaggcttccatctctactgggcttgaggcaagaacattgttagggacggcctgctcttggcctctgtgccccagggattgcaaatgcatgttcctcaaaggtaagggctgtatcattcggctttctttgtattcacaggtacagcttgtgctaggcagccggtgttcaataaatatcgtgcctaagga

SEQ ID NO: 70757 - DNA, 2181 bp, Homo sapiens
gggtggggtttatgagccttagttcttggaggattataagagtacttccccagttttgaggctggacagttaatatactttatatcaattatacatttaatataatttaatttaaaataatttaaagattcttaggagatagtctgactttcctgacctagatgggaatgatcagatagggattttttttgtggcacaggctaaatttgatggtgacatttatattgttgagaatgttacatcttattttaccacaacttttaaaaaatgttacatcttttgcagtaggatcagttgtgaggcacatagtagctgaggctccatggagccacctttcatttctttcagtcagagaggaggacagtctctgtctctgcatttctggtgtcttgcttgtcggtggcagagccatgcttgccggcatttgcttaggcggccatagtagttgctaagtgtacaggtgactgggcagggatgggaggtggccacaggtcagagacaagtgctcagtcagtccctggtgccaggactgtgtgcctcggtgccttgggaaatggaagctccctggtgcagctgcagctgtgggtggaggtagagaagccagcaagaccttggtcttaaccccgtgttcattttcttgctagctgtgtgacgttgggctacctcgcttctctgagtacaaatggtgtgtggtgaatgggtcccaggtatgctacgagctttgagggctgctctttttctcttcatagcgataagtgttaaactgtctttcttaggaaacgttcacagacttgcaacagctgatgtcctctgagtactgtctgactccctcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgtta

SEQ ID NO: 70758 - DNA, 2057 bp, Homo sapiens
gggtggggtttatgagccttagttcttggaggattataagagtacttccccagttttgaggctggacagttaatatactttatatcaattatacatttaatataatttaatttaaaataatttaaagattcttaggagatagtctgactttcctgacctagatgggaatgatcagatagggattttttttgtggcacaggctaaatttgatggtgacatttatattgttgagaatgttacatcttattttaccacaacttttaaaaaatgttacatcttttgcagtaggatcagttgtgaggcacatagtagctgaggctccatggagccacctttcatttctttcagtcagagaggaggacagtctctgtctctgcatttctggtgtcttgcttgtcggtggcagagccatgcttgccggcatttgcttaggcggccatagtagttgctaagtgtacaggtgactgggcagggatgggaggtggccacaggtcagagacaagtgctcagtcagtccctggtgccaggactgtgtgcctcggtgccttgggaaatggaagctccctggtgcagctgcagctgtgggtggaggtagagaagccagcaagaccttggtcttaaccccgtgttcattttcttgctagctgtgtgacgttgggctacctcgcttctctgagtacaaatggtgtgtggtgaatgggtcccaggtatgctacgagctttgagggctgctctttttctcttcatagcgataagtgttaaactgtctttcttaggaaacgttcacagacttgcaacagctgatgtcctctgagtactgtctgactccctcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgtttttt

SEQ ID NO: 70759 - DNA, 1544 bp, Homo sapiens
gggtggggtttatgagccttagttcttggaggattataagagtacttccccagttttgaggctggacagttaatatactttatatcaattatacatttaatataatttaatttaaaataatttaaagattcttaggagatagtctgactttcctgacctagatgggaatgatcagatagggattttttttgtggcacaggctaaatttgatggtgacatttatattgttgagaatgttacatcttattttaccacaacttttaaaaaatgttacatcttttgcagtaggatcagttgtgaggcacatagtagctgaggctccatggagccacctttcatttctttcagtcagagaggaggacagtctctgtctctgcatttctggtgtcttgcttgtcggtggcagagccatgcttgccggcatttgcttaggcggccatagtagttgctaagtgtacaggtgactgggcagggatgggaggtggccacaggtcagagacaagtgctcagtcagtccctggtgccaggactgtgtgcctcggtgccttgggaaatggaagctccctggtgcagctgcagctgtgggtggaggtagagaagccagcaagaccttggtcttaaccccgtgttcattttcttgctagctgtgtgacgttgggctacctcgcttctctgagtacaaatggtgtgtggtgaatgggtcccaggtatgctacgagctttgagggctgctctttttctcttcatagcgataagtgttaaactgtctttcttaggaaacgttcacagacttgcaacagctgatgtcctctgagtactgtctgactccctcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgaggcgcccaggcacagcaggacgacgcaacaacagagccacgtgatgaggactcgcgcccgaggatgtataccc

SEQ ID NO: 70760 - DNA, 2649 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70761 - DNA, 2264 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgtta

SEQ ID NO: 70762 - DNA, 2670 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgttaatcagttttcttaaagccagtgtttcactatagtgtatgcatcagtgtgaattgtgacttaggaagggacacctcaacagttcacaaagtaccagaatggaacttgcagagataatagaaggaagtgtggtggtgaaatttgtagaaagagttgaccatataccaaggaaagttcatgaaggaaagcggatgcctttattgaacctggtagataatcttgaagaaaaaagagacaaacattcaagtatataacacgtgtcctatttattacattgctttggagtactatctataaaggaggtttgatgttttcattactgtttttgtaaatatttcagcattatctttaaaaagtaaggacattggccaggtgcggtggctcatacctgtaatcccagcactttgg

SEQ ID NO: 70763 - DNA, 1298 bp, Homo sapiens
tcagcgtgtactgactgcatctgtgctcccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgtta

SEQ ID NO: 70764 - DNA, 1136 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaacagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgtta

SEQ ID NO: 70765 - DNA, 1553 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70766 - DNA, 2805 bp, Homo sapiens
  misc_feature (769)..(769): n is a, c, g, or t
ccagcctgtcctgcatctgctcaagctctgagtgttgctgggaccgtgcatccacttcctgaacctgtctgtgcacagccctgcgtctagccccagagtagcccgcctccctgcccgaggcccccagggctgttttgcagcaggatgagatctgtttgaggccaccctgcccttcttctgcagggctggggcaaaagggctccgcaggccgtctcagccaccccatttctagggcggcctgcttgtggcgcactagcagcctttctatgctgaaggtggtgggggtcttttcagtgtttttctattttctttcctacgaaacagagcccctccagggcaggcccaggcccctcccagcctgtccgggccacagatacctgcagctgtggccagtttccaggaggtctttgagcacacctgcttcagcagccctgagcacacctgcatcttcagtctcagtttgaggggctggaatggggagggaagatgatttggaaggatttggggagagaagagatatacaagccggggctgtctgggtttggcccaggtgtgtgcccctcttcaccactccactttgtagattccctgtggcaggggatgcggttgcaggccccacggaagtgcggagggtggaggtgacgctggctctgagttgggaaacaggcacgtttgtgggttcagagtcctgggagagtctcgccaaggaaacaggaccaggcctggggctcagagaggcaagaggaggggcagcctgggcagaggtggnctgggaagggggcagggaagaggctgcgggcagctgggggtggccctgtgctggttggaagctagcggtgagcgtcagatgggggctgaagcttgtcttagagaggggcaggagcactggtcctttgtttccagcttctgaagaggtaagaactccccaggagcaggggcagggggagggggaggaccatccaaggaaacactgcctcagctggcagggcagaggtacagagtcaggaccagaggcttggcaatagggagacggtagggaagctggtgccactggcagaacaggagcaagtagggggtatacttttaagagatgcctgattaaacctgggtttgagttctttttctgtcccttaccagctagcgtagtcttggttacttaagcactccgggcctcagttttgtcatctatgaaatgggaacagtagtgcagaccttgacacacaggagcttctcaaacagaaggaatgagaggtgcagagcagcagcaccaggagctccgcttcggggtgtgaatggccatgggcggacatgcaggtgcaggacaggcgaagtgtgggacagatgaagtttctagcctggactgtgaggggcctggcagcctcccctctcaggagcccctctacctgccctggtccttccagctggcccgtaggcaagctggggcatgcagggaaggccctctgtggggcccgaggatttgctggagagcactgtgggtacacaaggttggtgggggtacagggcgtgccagggcacctgcaaggagttgaggagcgtgccttaggagggaaatcagtatttgggctgactgaggggaggagctggagagcagaaggttccaggcccagcaaaagctgctgggatcaaggtgacagaatgagaaccaggtgggaacaggtagtacccagcccccataaacaattcctgctgggtcctcgggcctcccttggaatacagggggtgggctggttctgccacgcattgcagctggaggagacttctcaggtgagacgaggaccgttgctgcactctcacagacatgtgacaggcctttctgtgttgccttcccaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70767 - DNA, 2464 bp, Homo sapiens
ctctagaggactttacctaaatggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70768 - DNA, 2376 bp, Homo sapiens
atagactagtagatccccgagtttatcagacaggaggaagcagtatgatattactgtcggatgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70769 - DNA, 1878 bp, Homo sapiens
caagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagcacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagaggagtcgagacataagccaccttcagaggttcaatggaaactttaaaaccataccaaactcttttttaaaattagaattaacaagaaaaaaaaa

SEQ ID NO: 70770 - DNA, 1744 bp, Homo sapiens
cctagccggggtctctgcagtgcacgctctaggctacctttgggcccttttgaagcagctcttgggtttgttatgggtgttaagattttttcttttttctttgtgctttacttcatttcttaagaagcacatatttgtaaaacccatggagtagtgacttggaaaggagctggacagaggcagcagtccacccacaggtggggtatggagaccgcccgcttccttcctattccatgatgctgtggctctgggctgttggctgtcctcagttgcgcttgggattcctgccagccagcagctgctggagttagaggattctgctctccaagaatttgcagcttgtgtctgattaccgtaccgtctggcaaaaaaatacgtatgatgtttttacatttttaaaatcaaaatcctgatgtttttttgttcgtatggttgtttgtttcaacctcttaactcttgattttttctgttaagtgattttacgtctcttagctgtgcagaatgacaattaatgggaaggctgtcttccccatagtgagaccttggtaagggcagacctgactggtagattgtagattgggtgtgctcgtttttatatttcattttaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70771 - DNA, 1054 bp, Homo sapiens
aatctcctgaacgctgcctgctgagacttctcaggtgagacgaggaccgttgctgcactctcacagacatgtgacaggcctttctgtgttgccttcccaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagttaaaatttaaaataattttctaaattctgtatttggatattagtgtttaagtggtaatttggcaacagtttataaagtgatgttctgaataccataaattatgtgtaggactgtg

SEQ ID NO: 70772 - DNA, 954 bp, Homo sapiens
taggcaaccacgaatctgctttttgtttctgtggatttgtcttttctggacacttcttagaaacgtaattatataatatgtggtcttttgtgactgttttttttttcactttgcataatgttttcaaggttgatccgtgttgcatgtatcggaagttcttatggctgaataatatttcattgtgtagataaaccacattatttgtcagataatagacatttgggttattgctgtcttttggctattatgagtgttataaatatttgtgcacaagtatttgtgtagacatgtttgcatttctcttgggtatatacctaggagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaaacaagaagaaatattttcagagtatagtcaaaagtacactgagcatgggagaattgttttgacattttgctcaaaactatttctgaagaaaattcaacatttctttcacggaaagttttaggaacaggtaaatacaattatataaagtactggtagaatatgttcgttcagatgaccttgaagtgttttttcagacttatctgaacttgagatctgaactgaatttttattagaaactgttaaagcctctggcattgaaggttagttcataattggtgagttctgaatcacttcatttcctgcagtggttcctgagagaatcttagttcaaaggactgcccccgccaacccctgccccgccaaaaaaaaaaaa

SEQ ID NO: 70773 - DNA, 652 bp, Homo sapiens
ttctatactaggtatatgtagttagtaatagtgatttaaataatatctgtagagcacttcataggtttcagcatctttaatattatctctctgtttttataattacacttcgaaatcagtattaggtcttgcatcttacaattataataactgaagttcaaagaagttttgtgacttcttgaagactcagaagggaaacaaaggctggtacccagaccttgtaattgtgaaggctagtgctttacattttacttatttcctgaggtgaattaatcaaagcggtaataatgaaaacatttatttcatctttgtcaagcactattttaaacattttgtgcatttttaactccccacagcaacccaatgaattaaaaagttttatctccatttacaaatgaggcatagagcatttaggcagttcgcccacgatcacacagctagtgagcaactgcactgggatttgttcgctggcagtttggtgacaaaagaaaccccgtctcattagctgggcgtggtggcgcatgcctgtaatcccagctactcaggaggctgaggcaggagaatcgcttgaacccgggagtcggaggttgaggtgagccaagatcatgccattgtactccagcccaggcaacaagagtgaaacgccgtctca

SEQ ID NO: 70774 - DNA, 944 bp, Homo sapiens
agcggacttcgccattttcctccggaagtgcggatcccagcggcggtcgtgtagctgagcagccctggggcttggttctatgtccctgtggctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70775 - DNA, 944 bp, Homo sapiens
gcttcttttccgacaaaacaccaaaaagtgcggatcccagcggcggtcgtgtagctgagcagccctggggcttggttctatgtccctgtggctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70776 - DNA, 323 bp, Homo sapiens
ctttaggtacaaatcccagaaaaggtttgggtgtggatcctatcccccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70777 - DNA, 605 bp, Homo sapiens
agcggacttcgccattttcctccggaagtgcggatcccagcggcggtcgtgtagctgagcagccctggggcttggttctatgtccctgtggctatgtttccagtgtcctctgggtgtttccaagagcaacaagaaacgaataaatctctgttgaagagataccatttgacattttagagatggctgcatgcaaactcttaaaacatttgaggaacacttttatccaacttttctcaagtcagagtacaggagcacaggctgttcgacgtaggccggacaactcttcagctttgctgcttagaagttcattccaccagatacaccctaaatcatcaccctaaagttccgtttcacagatctccagggaatggtcactgtgtagccaattacttggctaaggcaaaagaaaaaaaccttggctccttttcccagtaagttcctcattttcatctgagaccttacaagcctgggccttcagtgtccatccttctgtcagccttttaatcataactatttaacaagtctctgcaatggtccaaactttccctcatcttgctatcttcttccaagctctccaaatctctaacctctggccattacccaat

SEQ ID NO: 70778 - DNA, 2236 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagcaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70779 - DNA, 2265 bp, Homo sapiens
  misc_feature (2251)..(2251): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagcaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttcaaaaaaacacaacanacaaaaaaaacact

SEQ ID NO: 70780 - DNA, 1816 bp, Homo sapiens
  misc_feature (158)..(158): n is a, c, g, or t
  misc_feature (299)..(299): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctggaaaanatagtatctcttgttgcaagaaatggtccatctgtgatttcaagtctctcgcttgagtgaattggatggaagtggtgaatttcagccaaagtggccaaagaaatcctgttcctgtgataatgacgccatcagcctctgcanctctgtcttcccttctgccacatgttgcctgttctccgtgactttgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70781 - DNA, 1451 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagcaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70782 - DNA, 785 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtacctgctctcacaccggcccaacatgcagctgtgccgcgaagcagcccagttcagagcgctgtgggagaagcttctagaaggggagcagtccctttgcaacctcgaggacatccacatgagcctggagaaggatgttaccgccatgaccaacagtctcttcatcgaccgccagaagtgcatggcccatcgtacttgctacacccccatcctgcagctggctggctaccagtgagcagcggcacggtgcttccccccaatcccccaaataaacagtgcattagctttctgcaaagtgtgtgtg

SEQ ID NO: 70783 - DNA, 823 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtacctgctctcacaccggcccaacatgcagctgtgccgcgaagcagcccagttcagctggtgagtgaggtggaggagctgaacatgtccatcacagcgctgtgggagaagcttctagaaggggagcagtccctttgcaacctcgaggacatccacatgagcctggagaaggatgttaccgccatgaccaacagtctcttcatcgaccgccagaagtgcatggcccatcgtacttgctacacccccatcctgcagctggctggctaccagtgagcagcggcacggtgcttccccccaatcccccaaataaacagtgcattagctttctgcaaagtgtgtgtg

SEQ ID NO: 70784 - DNA, 891 bp, Homo sapiens
agcggacttcgccattttcctccggaagtgcggatcccagcggcggtcgtgtagctgagcagccctggggcttggttctatgtccctgtggctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagcttcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70785 - DNA, 947 bp, Homo sapiens
  misc_feature (480)..(480): n is a, c, g, or t
  misc_feature (488)..(488): n is a, c, g, or t
  misc_feature (933)..(933): n is a, c, g, or t
agcggacttcgccattttcctccggaagtgcggatcccagcggcggtcgtgtagctgagcagccctggggcttggttctatgtccctgtggctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagcaaaaaaaaaaaaaaanaaaaaaanaaaaaattttgtggggggggggggagaaaaggttttataacccattctcgtgtggggcgcgcgcgcggggcccaactttggtctacgtgtggaactttgtggtcaggcagggtgtgtgtctcccagggagaaacccggggtcgcggacatgttcgttgcggtctctcggcccgtatagaaaagacggccgggggggggagcaacctcgagtggtggtgtttgggaccaatctcccaggtggggcgtggtctcgggaggggcgcattgcgagggcgcgtcttattccacaacggcggagttccgacggaggaaggtgctatatatataaaattaaacccggggccggttggggagaattttcacatttgactggtgaacattctttgcatccctttgtctaaagaactcatttggataaacggttcgacagaaaaaaacacaacanacaaaaaaaacact

SEQ ID NO: 70786 - DNA, 918 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgtgagttttttatttgttcttcactttgttttacactgtattttctgagtttatgggtgtctgtgaattaaaaaggaaaagtggaaataagtaaaactcaggttgaaggaaatatacataaataagataaagctgacctgtagatatagacaggttataaaagcttagagttgtctaagttgagtgcaaagtttcctctgatctttctgatgccgaaacaaaaaaggcagtcatgtttgttacgtgattggaatggaacccgaaaagagagcatgctgtgttcttgtgggacaggaaagcttgtgtgcaccaagtcttaaccaccaccttcattggtgacatagattatgtgctggaacatatttcacaccggtctggcagtaagcacttgtagtgttgtgcagtggaaacagtcatcttccgctaaggcatggcgtgttgtgcagtggaaatggtcattttccgctaaagcatggcgtgttgtgcagtggaaatggtcatctgacgctaaagcacagcatgttgtacagtggaaatggtcatcgtctgctaaagcacggcgtgttgtgcagtggaaatggtcatctcctgctaaagcacagcttccatcataaggtatgctccttgctcaaagagtgtggtcccaaacagcttttgggaggtcctccttgactcatggatgaaacccagaacatcttgaggactgagttaaccacaggtccttaaataactctccacacatttttcttagtttatctctacatgca

SEQ ID NO: 70787 - DNA, 1034 bp, Homo sapiens
ggctgtactggctgggattatgggcataagtgcggatcccagcggcggtcgtgtagctgagcagccctggggcttggttctatgtccctgtggaatgcacaagatttgcaaagactaggtgatagtggaaggtttggaagaactttcagaaggttgaggtgaattcagctgagaagaacagctatgtttccagtgtcctctgggtgtttccaagagcaacaagaaacgaataaatctctgacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70788 - DNA, 849 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgatggattttccctccagcctgggtgacagagtaagactccgtctcaaaaaaaaaaaaagcttaataatttattacatcccaaatttttaaaatttggagtgccttggcagtggggatggttcctaaaatggcgtatagaattagcgacagaatggtgtgtaaggtcctgaatctggtaaaatacaggggatgtatgtatgcggaattatgaggcataagtagccagtatctatagtagaatctacaagggctccttttgggacctgtagactagaatatacgtgtgtatgggggccttgagtggtatctctcagggttagaggtgctggttcaagcacaatttagattagggttggacaccagtcatggtccaactccatgcggtgggctccattgtaaaacttcactacttcagtacacaagcaacattagggaacttctaaacggaagtggattgcgactttcaagagtatagtggtggcctagggcattactggggaactttttaacaaatagattctactggtcctatgggttcataacaacacaggttggagcaactacaataggtgttcattaggtcaagactaatgcgggattatatcccaaataatttcttggggtgaatagtgtttactatataacctcgggtagggagaccagcggaccgctgtttggttagctaaccgtgggcacg

SEQ ID NO: 70789 - DNA, 1007 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgttgaagagataccatttgacattttagagatggctgcatgcaaactcttaaaacatttgagacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70790 - DNA, 757 bp, Homo sapiens
  misc_feature (290)..(290): n is a, c, g, or t
  misc_feature (298)..(298): n is a, c, g, or t
  misc_feature (743)..(743): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccataggagttttagccaattcagagggcttgctgcctgcaatttggaaaattccttggatttgaccaaatcaggaagagacgggagaaaagtgaaacaagaataaagccccagacataaacaaaaaaaaaaaaaaanaaaaaaanaaaaaattttgtggggggggggggagaaaaggttttataacccattctcgtgtggggcgcgcgcgcggggcccaactttggtctacgtgtggaactttgtggtcaggcagggtgtgtgtctcccagggagaaacccggggtcgcggacatgttcgttgcggtctctcggcccgtatagaaaagacggccgggggggggagcaacctcgagtggtggtgtttgggaccaatctcccaggtggggcgtggtctcgggaggggcgcattgcgagggcgcgtcttattccacaacggcggagttccgacggaggaaggtgctatatatataaaattaaacccggggccggttggggagaattttcacatttgactggtgaacattctttgcatccctttgtctaaagaactcatttggataaacggttcgacagaaaaaaacacaacanacaaaaaaaacact

SEQ ID NO: 70791 - DNA, 754 bp, Homo sapiens
  misc_feature (158)..(158): n is a, c, g, or t
  misc_feature (299)..(299): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctggaaaanatagtatctcttgttgcaagaaatggtccatctgtgatttcaagtctctcgcttgagtgaattggatggaagtggtgaatttcagccaaagtggccaaagaaatcctgttcctgtgataatgacgccatcagcctctgcanctctgtcttcccttctgccacatgttgcctgttctccgtgactttggtaagagcttccttgtgtatgaggatgatgtccaggatgttggtctggtgtccctgagacagactaacaggtccatggctgggtccaggtccttcctggactcattggccaaagagctactgatgttcttgaaggcatctctggtgaagtggatggcctagtcaagttccaagggcctggtgaggctgacagaaaaactggcaccgttctgatgctctttctatcagcgctgtgcatgtcatctgattggctgtcaactcatgggctgtgcaggatgaagctgcctggcccgtgtacatcttcttggacgaagcattggaagcatcagtcgtgctctccacgcttaagggtgcggtccccactgagggttgtctgaaggtctcacagaagcggcgcaaatctctctgaa

SEQ ID NO: 70792 - DNA, 1266 bp, Homo sapiens
aatcctccttttcagtcaagttctcacttagttgagagtgtgaccaaaatgtagggccttagcctcactcttagttaccattgttttgggtttccggtttagcacatcactcccattgttttgggtaatggttttagcacgtcactcccattgttttgggttctggttttagcatgttactcccattgttttgggtttctggtttagcacgtcactcccattgttttgggttctggttttagtacatcactcccattgttttgggttccggttttagtacatcagtcccattgttttgggtttctggtttagcatgtcactcccattgttttgggtttctggtttagcatgtcactcataggttacggtgtccttatgattgcacatttttttaatctgttgtcattccagttgaagagataccatttgacattttagagatggctgcatgcaaactcttaaaacatttgagacccttctcaggtgcagccagagagacactagcccactgatggatggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagtttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaaactgagtgcagattaaagtcttttgtgattcaaacatagtcaagagtaccactgtgatatttcatggaagttatgcaataaaatgtctctaacctgcgaacaaatctatcaagcagacggcacagtactgaatttgaaaccagaa

SEQ ID NO: 70793 - DNA, 364 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgagaggtgcccagtgaatgcaggttccagacaaaaggtggagcctggcatcctgccctgcatgggctccagcctgctgccatctggggaaactgagtatggcgaggctcaaggatgtttctcagaccacaccagtccctgaaggtccgctgacctcccaatcttgacggacaatgagaagagcttcccaggccacctgcaataggttctggct

SEQ ID NO: 70794 - DNA, 1623 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70795 - DNA, 1623 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70796 - DNA, 2212 bp, Homo sapiens
  misc_feature (2088)..(2088): n is a, c, g, or t
  misc_feature (2091)..(2091): n is a, c, g, or t
  misc_feature (2094)..(2094): n is a, c, g, or t
  misc_feature (2096)..(2097): n is a, c, g, or t
  misc_feature (2100)..(2101): n is a, c, g, or t
  misc_feature (2103)..(2103): n is a, c, g, or t
  misc_feature (2209)..(2209): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagcaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccatccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagcaaccacgccnccnccncnnccnncnccccccccccccaccccccaccacacgcccccccccccccccccccccccccccccccccccccccccccccccccccaccccccccccccccccccccccccccnccc

SEQ ID NO: 70797 - DNA, 838 bp, Homo sapiens
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcactgccatgaccaacagtctcttcatcgaccgccagaagtgcatggcccatcgtacttgctaccccaccattctgcagctggctggctaccagtgagcagcggcacggtgcttccccccaatcccccaaataaacagtgcgttagctttc

SEQ ID NO: 70798 - DNA, 792 bp, Homo sapiens
  misc_feature (792)..(792): n is a, c, g, or t
ggctgtactggctgggattatgggcataagtgcggatcccagcggcggtcgtgtagctgagcagccctggggcttggttctatgtccctgtggctatgtttccagtgtcctctgggtgtttccaagagcaacaagaaacgaataaatctctgggaccccgtcgatggcgcccagtacctgcgtctcaggaagaggttctggtggggcctccgcctgaggccgcgcccctggggcctgtcccgcgtccacgtgaacgcggagcgcagcattcaccatcccctccctgaaacagcggtccccgaggtgctccacaggcagggccgagctgggcaagggggagcccagcccctgaacgggccgccctgagcggcggggatgcaagaagagctcgccggctccaccagcccctaccccagatgcaggacctcagaccagagaggacctggagcccccgccccacggttgccaggaggcggacaggggcagctcctgggggggctaccgccccgaggccgttccgccagaacttgagcgacttgggaaggcgcagtgccctgcccttgaagaggaacctgtgtgctggaggcagcagcctgggagctcctcctccgaggacaccgcagaggcgagtgactctggcagcgcagcgctggctttcccgtccgcggaggagagctgtggggctgggtgagctggaccagtggagcacgggtggctgctctcggcctcctatggggagtggacagttagggggttgtccccatgcccagccggatgctggccactctgggn

SEQ ID NO: 70799 - DNA, 2317 bp, Homo sapiens
cagccttaccccttactggaggctgcaggaccctctacacacagacagctgtccagcacggaaggtgggctgaggccagggtgaacatgccagctaatgggacatcaccccagagattccctgccctgattccaggagaacctggcagatcttttgaggggtccgtgtcattcgaggatgtggctgtcgatttcacccgacaggagtggcacagactggaccctgctcagaggaccatgcacaaggatgtgatgctggagacctacagcaacctggcatctgtgggcctctgcgtggccaaaccagagatgatcttcaagttggagcgaggagaagagctgtggatattagaggaggaatcctcaggccatggttactcaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtaatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcaccacagtgtgctgtgaaaatttggcacctacatttgtatcaaagtatgtcctgatccccttaggatagctcattgtttttattcagatttccctaattagtggtgtgtgaacatcttatctgttgattggctatttgggttttttcttctgtgcattgactgttcatgtcctctgctcattgttttcaaatgggctgttcatctcttgctttttggttcacatgttgttttttaacatatgagaatatataaaaatcctttttttttcagtcatatgtgttgcaaatatcttctcccagactgtcgttggttttttaaattttgccatctgttttcttctgctgaagttttatattttatttatttattttttattttttgagatggagtctcactctgtcacccaggctggagtgcaatggcatgacctcagctcatttcaaccttcgcctcccgggttcaagcgattctcctgcctcagtctcccaagtagctgggattacaggtgtgcaccaccatgcctggctaatttttgtatttttagtaaagacgggtttcaccatgttggccaggctggtctctaactcctgacctcaggtgatccacctgcctcggcctccaaaagtgttgggattacaggtgtgagccaccgtgcg

SEQ ID NO: 70800 - DNA, 157 bp, Homo sapiens
gcataaatgagatacaggaaagcacttagcatggcacgtggtaagttgcaagtattcagttaactgaagcacttaccatttatgccttcagttcattcaccacctcattaattgagaatcgagtggtttagagaacatacttagttgggaaatttag

SEQ ID NO: 70801 - DNA, 198 bp, Homo sapiens
gcccggcgaccgtaggcatcttctggaccacaaaatagaacattgccaggcaaggcagggcatttggggaatttgagagaaagcaggatgagtgatggaattgggagggtggcacaagatgttaaacagcatatcttagtcctcatctagggtataaaacaggacccatggactctagcatcctggaatgacagaggg

SEQ ID NO: 70802 - DNA, 3141 bp, Homo sapiens
  misc_feature (6)..(6): n is a, c, g, or t
  misc_feature (11)..(11): n is a, c, g, or t
  misc_feature (90)..(91): n is a, c, g, or t
  misc_feature (97)..(97): n is a, c, g, or t
  misc_feature (103)..(104): n is a, c, g, or t
tgcttntatanaagcatttaatgcaacagtgttcatctgagtattgcttttgagtgccaaaataccatgtttttcacactccaaactctnnggaagncttccnnagacaacttgtcccttatttataatactatatattaaagtaactgaaagtattcaaaataatgcttactttgtgcagagtccatgaactctaaccaaaatacataaatgtcaaatttgagcaatacattttgattgattttaaaattccatttgaggcactacttttctgaatagatgcccaaggaaaatattttaaaatattgttgtattaaaaaattgtttcctatagaatctgaaaagttctttaggtagacttttagtaaaatgtttgaacagtttaaatgctatttcagactgtcagaatgatgaatgtttttaaattattttcataatgatttatcactccagtttacagtacttgaaaaatttttttcgcttcacctaaataactggcatttttgtgttatgttcttttcctcgttttatactctgctctgaagcactttcaaattaaaaaaagaacagtattgtattctagggccattagtgaatgtgcatgagctattatagtcaatgaaataagcattatatgattgaagattaactaagaaaatggattatggtgtaattaaaaacaccaagataggcgggatgcagtggtttatgcctgtaatcccagcactttaagagaccaaggcaggcagattacctgaggttaggagttcgagaccagcctggctaacatggcgaaactctgtctctactaaaaatacaaaaattagccgagcgtggtggcaggcgtctgtagtcccagctacttgggaggctgaggcaggagaattgcctgaacccaggaggaggaggttccagtgagcctagatcatgccactgtactccatcctgggtgacaagagcaagactcttgtctcaaaaaaacaaaacaaaacaaaacaaaaacaccaagatattcctggaaaagctatgaaaatatgtttttcagttaaggggaagcacttatcaatgctgccagtcctggtaaagattgtcaactctaacataatataaagcaggcatttcttgtaataaatatgaagaggatattagccttgatcttagcataactctcttccaggtaggactccagcttctgaaagtaattttgtaatgctcatcaactgaagatgactgtaaagcttggcaccagttcctggaggcagccatgtttctgattaaagtctgggcctagagagctgtatggaaaggtttggaatagaggtgatttagcctaaagaaaattgctaaaccatgggttacacactggtggcctgtagtcctattttgttagacacagacaatggattttatttgtttttcatatttgaattaatttctgaattcttgaatattggcagattatgctacaggaatctaaattactctcatttctgcatgtcattaaaaaagtagagatgagtagcaggccccttttccctggggcatgtgcttcccagctacatacacagcacccaccacaccagagtttccctacctggcaactaccagttatcatcactccttaagcagctgttttcttacagtgaagaagttccgtttccatggtgctatcaaaagtaagaaaaggaactatagtttgagaggctgtgttcttaacccattgatgctcctaatgggccctgaagatatttgaccttgtgaccatgtgtaataaggtgatacatgttcatcaaattgtggtgtcctcctcccctgactttcaaatggaattcagatacaatttttacccttattacgattacctacaattataattatgctacttctaagtatatgacctggggcaagtttcttgacctctctatgcctcacattcctcaaccataaataggggataaaaatagtacctatatcatagagttgtcaaaagaattacatgagttaatgtgtggaaagcactgaagatagtgcctggtaaatacaatgtaccatgtaagtgttcactgttgcagtcctcatttattttctgattatactaacatttcacttattctgtgttgctcatgtcacctcctaatttgtaagtgactggtagaaagaaacttgtcccaagggtatctgaccttcacccacactcagcacttccatcagtctgcatcagttttagggcctggagatgtatttgcacatattgaaggaggtaaataactacagtgaataagataacattcagaaattcaggactgcgaccttagagatcatctagtccaggagttggcaagctttttctgtatgggaccagactgtaaatattttggctttgtggccatattgtctctgtggcaactactcaactctgctggtgcaatgcaaaagaagccatgggttatatggaatgaataggtgtggctgtgttccaataacactttatttatagacactgaaatttgaattgcatataattttcacatgtcattaaatattattcttcttttgattttttttcaaccttttaaaaatgtaaaaaccattctcagctctgggctataaaaaacaggtggaagatttcacccaggaattccacctggggatttttgttgaacagtgaagctacctgggccccactccaaacccattgaataaaaatctctgggtggtggggcaatggaatctgtgctgtgaacatgcgtgtgatccctaccagtgtggctctagggaccacactttaagaaactacccaagtgtggagactttatggccctcctcacagatctaaaaatgatttattaaggttggttataacaagtaccacactgcaaatatgaatatgatcacttttgtcttaaattacttaaatttactcttcacattctcttatttttattatcaaaatttcttgtagacaaaggtcattattttcttctactatgtttaaggaatgtgacagcaccttgaacttaccctaaaatcactgtacattagagaaatcctatttcatgttttcatcaatgtgggaatatgtgcatgtttagtgacattctttgtggtggcaaaaagtaaaataaactctgaaaataactt

SEQ ID NO: 70803 - DNA, 583 bp, Homo sapiens
gaaactccgtctcaaaaaaatgaaaaacagaagattgctaatcagaaacatgggatttgagcctctaaatagctattgactgattaaatacaatgtaaaatgtatcctttgggacttatcttcctctggggcctgttctggaattgcaggattgggttatgagtatgaataaacatgttagcaagcatgttgtgctgagaagtattgaagctgtgtaatatagtgaggagttatagatttcagtgtcagatacaacttggtttaaatcctggcttggctatatattagttgtttaagaagccatttcagctagctcacaaattcgttaagtgtggcctgtggacccttgggtctctaaggtggtacagaggcaatggagggtaaaactgctcgtgccttagcatgaaccaagggaatgacactagaatatactgattatcattgagttcttcaccaacatgcctgcacagtaaaataaaatgccagtttcacttaactctcaatcctttagaatatccattatttgaaaagtctggtgggattacaggcgtgagccactgcgtccggcctgagactccccatc

SEQ ID NO: 70804 - DNA, 1670 bp, Homo sapiens
gacacactcctctacaacaccagagactcccaaacacaaggccttatattgactcatttcagctcacatcctggcgactctcaagagagaaacctcagagtgactaaaatctccataatgagaagacatgtacattcagtatctattttggcattttccccaatacatctctgctcatctgactcttatcttggcatctgcttcctggtggatctgaactgacccataagccacgcttactggtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttc

SEQ ID NO: 70805 - DNA, 5053 bp, Homo sapiens
  misc_feature (2587)..(2587): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70806 - DNA, 5501 bp, Homo sapiens
  misc_feature (3035)..(3035): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcctgcggttcagcaagccccgagtgcagttattccctccacccctcgccctatcttctcctcctccaggcaacttctttgcttcaagaaagttgcataattctcgaggccaggagggacccctcccccatcctgctggtcttaccgctgagtgtctgggatctccaggcgggcaattatctgtctcctcgtttccttttccctctattctttctcccaccatctcgccctctcaccctgtaaccctcttacccacttcctccgactttaaataaaaggctgatctgaccttcttaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70807 - DNA, 4993 bp, Homo sapiens
  misc_feature (2527)..(2527): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacgaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70808 - DNA, 5208 bp, Homo sapiens
  misc_feature (2742)..(2742): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70809 - DNA, 5096 bp, Homo sapiens
  misc_feature (2630)..(2630): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcatcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70810 - DNA, 5269 bp, Homo sapiens
  misc_feature (2587)..(2587): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttccaaaaaaaatacaagaataagaataatagaaaaaagaaaaataatgaaagaagaacaagaaaacaaaggagagagacgaccgagatgaggagtgacggatcagagacacgatagagagccagggaagtatggagagccagacgaaaaagatgaacagggggagtcgggtcatggttaggaacatggttgagaatagacgtgtgacggtgagggggggt

SEQ ID NO: 70811 - DNA, 3802 bp, Homo sapiens
  misc_feature (35)..(37): n is a, c, g, or t
  misc_feature (1336)..(1336): n is a, c, g, or t
cctacctatcaccaccagcacccgacgaagaacannnagctttatgaagagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70812 - DNA, 2511 bp, Homo sapiens
tctgttttttcattatgcaaatctcctcttacctcttcagagtgaccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70813 - DNA, 2505 bp, Homo sapiens
  misc_feature (2)..(2): n is a, c, g, or t
anttgaatatgtgacttcagtccatagaatgagaggctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70814 - DNA, 1810 bp, Homo sapiens
ttatttggtggggttatttaaaataaaattccctttttatccccgcggaaaaaacacatgcaaagaggcccattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70815 - DNA, 4134 bp, Homo sapiens
  misc_feature (2587)..(2587): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttctatctattagtatacacaaagggtccatattttattctgaaaaaatatttattatattcattcacaaatgttctaactaatttaac

SEQ ID NO: 70816 - DNA, 1694 bp, Homo sapiens
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttc

SEQ ID NO: 70817 - DNA, 449 bp, Homo sapiens
tgatcggtaacttggtcggtgatcggtaacttggttgtgatcggtacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70818 - DNA, 2043 bp, Homo sapiens
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatcc

SEQ ID NO: 70819 - DNA, 5029 bp, Homo sapiens
  misc_feature (2563)..(2563): n is a, c, g, or t
gacacactcctctacaacaccagagactcccaaacacaaggccttatattgactcatttcagctcacatcctggcgactctcaagagagaaacctcagagtgactaaaatctccataatgagaagacatgtacattcagtatctattttggcattttccccaatacatctctgctcatctgactcttatcttggcatctgcttcctggtggatctgaactgacccataagccacgcttactggtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70820 - DNA, 5419 bp, Homo sapiens
  misc_feature (2953)..(2953): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcctgcggttcagcaagccccgagtgcagttattccctccacccctcgccctatcttctcctcctccaggcaacttctttgcttcaagaaagttgcataattctcgaggccaggagggacccctcccccatcctgctggtcttaccgctgagtgtctgggatctccaggcgggcaattatctgtctcctcgtttccttttccctctattctttctcccaccatctcgccctctcaccctgtaaccctcttacccacttcctccgactttaaataaaaggctgatctgaccttcttaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcatcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70821 - DNA, 4394 bp, Homo sapiens
  misc_feature (1928)..(1928): n is a, c, g, or t
ccgcccacgcggcggggacgcgtgggcggcactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70822 - DNA, 4262 bp, Homo sapiens
  misc_feature (6)..(6): n is a, c, g, or t
  misc_feature (132)..(132): n is a, c, g, or t
  misc_feature (146)..(146): n is a, c, g, or t
  misc_feature (172)..(172): n is a, c, g, or t
  misc_feature (201)..(201): n is a, c, g, or t
  misc_feature (241)..(241): n is a, c, g, or t
  misc_feature (296)..(296): n is a, c, g, or t
  misc_feature (1796)..(1796): n is a, c, g, or t
aagccngccccccagcctgcagaaagcgccacccgccgcatgggggctgcattgatggtactggcgcgcaagtggcggcttgagcgcagctgcaggccaggcaggcagggcaggcaggaaaagctggcgggncttgcaggagaaantgccaggattgggaggaggaagaaanagggatttgcgaaattggcggcgcaaagnagggatggctgcattggaggggcagggagaggctggcgcntgctggtgcgagcaggctgcgcccattgggagaggctggagagctgcttggcgcnccagtttgcagggctgctgtgcaagcgcgcagcgcgcagcgatgagcgcccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtattttttaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataatttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 70823 - DNA, 3801 bp, Homo sapiens
  misc_feature (2587)..(2587): n is a, c, g, or t
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctnccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcacaatgtgataagctccatcttccaacctaatttttaattgtctc

SEQ ID NO: 70824 - DNA, 1819 bp, Homo sapiens
aactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttc

SEQ ID NO: 70825 - DNA, 755 bp, Homo sapiens
  misc_feature (755)..(755): n is a, c, g, or t
aacactgcctttgaggtggcagagaaatacctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcggaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacttcaccccgaggagctgggggaagctcctgccaagagggcgaatactgatccgcgatggtgcctacaaggttccgtgcccgttgaacctggataagtgcctctcagtgcccttgggagaggccttgccaaactgggttcttgagn

SEQ ID NO: 70826 - DNA, 479 bp, Homo sapiens
agccttgtgtgtggacatcttttataaatccacccatattagtaaatgatgccatcagccccattttgcagatgagaaaactgaagcccacatgggttagtgacttgcccaagagctttctcgtatatcccagacaagttggctcaaagcaacaggggctgaggtttgaggggctggagcccatctcccctaaagccatttcccagcccccagagctggctctggcataactgccctcctcccaggtccgaaagctggtgcccagccgtgaccagacactgcaggaggagctggcacggcagcaggtaaacgagaggctccggcgacagtttgcggcccaggccaatgccattggaccctggatccaggcgaaggtggaggtaagggctggatagtgggtccacctagggggatggggccaggctggacacaggagttggagcctcatgatgcctcatgctgcctgggaaccccctgca

SEQ ID NO: 70827 - DNA, 1094 bp, Homo sapiens
gggcatccagggtgagatccagaagttctgccagacgtatgggctgcggccctgctccaccaatccctacatcaccctcagcccgcaggacatcaacaccaagtgggatatggtccgaaagctggtgcccagccgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcggaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtctct

SEQ ID NO: 70828 - DNA, 334 bp, Homo sapiens
agcaagttgtagcttccttcaagatcttggcaggagacaaggtgagtcccaggcggtggaggggctggtgggctagggcagggcacgggacctgtgggctcaacgcctcttctccccagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctga

SEQ ID NO: 70829 - DNA, 1607 bp, Homo sapiens
attagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70830 - DNA, 1525 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70831 - DNA, 1558 bp, Homo sapiens
gggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70832 - DNA, 1639 bp, Homo sapiens
gccggggttcattcattgccggcctgaggactcctagctcggccccgctccgcgctacagcccaaagcccagcctgagacccagccgccctcgtatgcccacggcctagctccccttccctccaacagacagactgggaaaaccgagtgggcgacggctgagcaaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70833 - DNA, 1818 bp, Homo sapiens
gggccgtcagcacttaaagggcccgcggctcgggcgtaggaggcggtgcctctgcagcaagcgtggggcgcgggaacccgagcagtatctgtatctgtaaagtgccagtgataacacctgtctcaccgagatgctgggggaattcaggaaaatcatgcaaaagtgcctggtacggagcctggcacgcagagggctcttggtcaagtgggttggagctgcgtgagcccagaaggggatagaggcagcgtggaggaaggcggcagcgggcccggtcgctgggaatgaaaggcctcagtgtctggggcttcctccccgtactacccgcagagtttgttcagggtggaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70834 - DNA, 1432 bp, Homo sapiens
gggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70835 - DNA, 2147 bp, Homo sapiens
gccggggttcattcattgccggcctgaggactcctagctcggccccgctccgcgctacagcccaaagcccagcctgagacccagccgccctcgtatgcccacggcctagctccccttccctccaacagacagactgggaaaaccgagtgggcgacggctgagcaaggactctccagtcctcagtcaccttggacaaagaagtgtggatcctcagattccatcttttccaactccaaggcaagtggaactagaaaataaggtgcctgtgtgtcaggtctccccagctctgctgtggcgggcccttaagatcacctcactgaaccctcacgctgcctcatgaagtttatacaattattagctctgttttacagagatagaaactgaggccaagaggctaattaatttccaaagcctaaggccagaaagtgatggtacccagacttgccccagggctgacttctgagccagtctggtacctagggcacactgccgcctccttccaaagcgagcttagggggcaggattccagtgggaaggaagctctgagcaggcagcctcagccacctctgagactctgtatcctgggccaggtgccatggcagagaaggtgctggtaacaggtggggctggctacattggcagccacacggtgctggagctgctggaggctggctacttgcctgtggtcatcgataacttccataatgccttccgtggtgagcggggcagtggggctggggctacttgaggggatggcagaagcaaaaccctgggttccacctccaccaccgggcggggaatgtgtgtctggctagtccctgggaacacagcaccccatgtcgtgatgatgtggcctacatgtaccctaccagagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70836 - DNA, 1636 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70837 - DNA, 1507 bp, Homo sapiens
gggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70838 - DNA, 1018 bp, Homo sapiens
cacacacccacccacaatcatcagtagacctcgtgttaatcggcagagggcctgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70839 - DNA, 1879 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccgccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70840 - DNA, 991 bp, Homo sapiens
acacaacactggtcagggcaatcattttttggatttgaccccaaaagttcaggcaacaaaagcaaacatagacaactgggattacaacaaaccaaaaagctgcagcatggcaaagtaaacagactgaagagacaacctacaaactgggagaatatatttgcaagcaatacatctaatatgggtttaatatacaaaatatagggcaggtgccacaactcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70841 - DNA, 2022 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccgccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70842 - DNA, 1574 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggccaggcagacaagacttggaacgcagtgctgctgcgctatttcaaccccacaggtgcccatgcctctggctgcattggtgaggatcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70843 - DNA, 572 bp, Homo sapiens
gcggccgctcccacttcagatttagcccctccctggcccctaactgcaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70844 - DNA, 1481 bp, Homo sapiens
attagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70845 - DNA, 1945 bp, Homo sapiens
gggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagggtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaacaaaaacaacaggtgagtgcaggcaggcaggctgagggcattgccaaggactaaaaccagtagagcaacctctggccatgtcacccctgcagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70846 - DNA, 1974 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggtgagcggggcagtggggctggggctacttgaggggatggcagaagcaaaaccctgggttccacctccaccaccgggcggggaatgtgtgtctggctagtccctgggaacacagcaccccatgtcgtgatgatgtggcctacatgtaccctaccaccctacagcgtctcttcaaaaagggtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaacaaaaacaacaggtgagtgcaggcaggcaggctgagggcattgccaaggactaaaaccagtagagcaacctctggccatgtcacccctgcagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70847 - DNA, 1447 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70848 - DNA, 1392 bp, Homo sapiens
gggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 70849 - DNA, 1708 bp, Homo sapiens
caggctgtactgtctggaagttacggatcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactgggaacacaaacacaaacgaaccaaaacaaaaacaacagaaacaaaagaaccgcaggggcactatcaacgcgcgcggaaaaagacgagcaagaacagagacagcgggacaaaggggggtctgaggaccagagcatagtgcaacagaggggaaacacgggcgagcacaccagaagggcggcgcgcac

SEQ ID NO: 70850 - DNA, 2934 bp, Homo sapiens
gttgtccagtttaacagttatataatataatcttttatgtgagaattttgaatagcacaacagagacaagaaaacagactaacttctccttggtatgaccacatcttggcaaaaagtgaaagtcctatttaaaatgtaaaggaaatcctatttggtgaaccctgtaataggtgggggctaaaagggaaatctaggttgctggatttgtcactagggtttcctctagtaatagccagagggttccagttagtgtcacctcccagtatgaaaataaattttctttcaggctttgtttgtggagtggtaggtggagcatttttttaggtcctgatgacctggaaggtgactcataatcaccctgaaacgtatgaggaccctaaggaaacctcccctgggggagacagagggctggggttagagccattgcgttgggctcgtctggcaccttctggtgtgtgcggcacctggtgggggttcggcacggagccgcacccaacactgacccgggcccccccacccctgtcctgagcccaggcgcttcgccctgtcccacctagctctgagcagcgccccccagcaccctgaatgcgtccgcaggaccccgcgctctacccgcaggccccgcaccccctagctctgggccgcgcctcacatccctcccagagccgcaacaccccacccgcgggacgccctcgagcagccgctcgttgcgggcctgaagcgcagagcgcctattggccagagcggccgagggcgggaaaagtggccaacggctgcctcggccctcgggctgctgaggagatggcgtcgggctccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaagtacagatggggtttctccagttggtcaggctggactcgaactcccgacctcaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagattggttgatgagattttggaggaactggaacacagtgtgcctcttttggaagtgtatcctgttgagggacaagatactgatatacatgttattgctttggccttggaagttgtcaggttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatcatg

SEQ ID NO: 70851 - DNA, 2881 bp, Homo sapiens
gttgtccagtttaacagttatataatataatcttttatgtgagaattttgaatagcacaacagagacaagaaaacagactaacttctccttggtatgaccacatcttggcaaaaagtgaaagtcctatttaaaatgtaaaggaaatcctatttggtgaaccctgtaataggtgggggctaaaagggaaatctaggttgctggatttgtcactagggtttcctctagtaatagccagagggttccagttagtgtcacctcccagtatgaaaataaattttctttcaggctttgtttgtggagtggtaggtggagcatttttttaggtcctgatgacctggaaggtgactcataatcaccctgaaacgtatgaggaccctaaggaaacctcccctgggggagacagagggctggggttagagccattgcgttgggctcgtctggcaccttctggtgtgtgcggcacctggtgggggttcggcacggagccgcacccaacactgacccgggcccccccacccctgtcctgagcccaggcgcttcgccctgtcccacctagctctgagcagcgccccccagcaccctgaatgcgtccgcaggaccccgcgctctacccgcaggccccgcaccccctagctctgggccgcgcctcacatccctcccagagccgcaacaccccacccgcgggacgccctcgagcagccgctcgttgcgggcctgaagcgcagagcgcctattggccagagcggccgagggcgggaaaagtggccaacggctgcctcggccctcgggctgctgaggagatggcgtcgggctccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagattggttgatgagattttggaggaactggaacacagtgtgcctcttttggaagtgtatcctgttgagggacaagatactgatatacatgttattgctttggccttggaagttgtcaggttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatcatg

SEQ ID NO: 70852 - DNA, 3107 bp, Homo sapiens
gttgtccagtttaacagttatataatataatcttttatgtgagaattttgaatagcacaacagagacaagaaaacagactaacttctccttggtatgaccacatcttggcaaaaagtgaaagtcctatttaaaatgtaaaggaaatcctatttggtgaaccctgtaataggtgggggctaaaagggaaatctaggttgctggatttgtcactagggtttcctctagtaatagccagagggttccagttagtgtcacctcccagtatgaaaataaattttctttcaggctttgtttgtggagtggtaggtggagcatttttttaggtcctgatgacctggaaggtgactcataatcaccctgaaacgtatgaggaccctaaggaaacctcccctgggggagacagagggctggggttagagccattgcgttgggctcgtctggcaccttctggtgtgtgcggcacctggtgggggttcggcacggagccgcacccaacactgacccgggcccccccacccctgtcctgagcccaggcgcttcgccctgtcccacctagctctgagcagcgccccccagcaccctgaatgcgtccgcaggaccccgcgctctacccgcaggccccgcaccccctagctctgggccgcgcctcacatccctcccagagccgcaacaccccacccgcgggacgccctcgagcagccgctcgttgcgggcctgaagcgcagagcgcctattggccagagcggccgagggcgggaaaagtggccaacggctgcctcggccctcgggctgctgaggagatggcgtcgggctccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggtgagcggatccgggacaggaagactacggtcggaagctcgtcggaacctggggacaggcatctggggcttccctcttaggcggatggggatccacagggcacaacgaaaacttgcgtttcaaaaaagtaaatggagtcaacatgtatagagcgttcaccttgttagaggtgcccgcgtcctgccctagaggagttaaggttcgagtttccgacaaaattcgtcaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtttcaaagttactgtttctgttgctgagcccttttcttccaacattgcaaatattccaagagattggttgatgagattttggaggaactggaacacagtgtgcctcttttggaagtgtatcctgttgagggacaagatactgatatacatgttattgctttggccttggaagttgtcaggttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatcatg

SEQ ID NO: 70853 - DNA, 622 bp, Homo sapiens
gcagtttggtgctgtgcccacaccactctaaaattaatgattaattgaatcatttgaggtcgctcaaattaaactaatttggcattgtgtgggtgacaaccagttgaaatgttttctttttatcagctatgtggccatatttttggagagagccagagtcttctgtctcttttctacctgtaatctattccaggtgctaagaactgtgaaagtccagcttgggtaatgtagtgagaccctgtctctacaaaaagtaaaaaattagccaggtgcagtggcacacgcctgaggccccagctacttgggaggctgaggttggaggatcacttgagcctgggagtttgaggctgtagtgagctgtgattgcaccactgcacttcagcctgggcactggagggagaccgtatctaaaaaaaaaaaaaaagccaagttattccttccggcgcaattccaggttacatgggccaattcgcctattagggagccgattaccatttaatggcccgtggtttaacaccgcggaacttgccctgcggtacccacctaattggcttggaagcaacgtttggcaaccttaatggccaaggaaatttgaagcttaatttttgtactccgttttttt

SEQ ID NO: 70854 - DNA, 435 bp, Homo sapiens
ctctgttgcccgggctggagtgcaatggtttgatctcagctcactgtgacttccacctcccaggttcaagacattctcctgtctcagcctactgagtagctgggattataggcatgaacaaccatgcccagccgtgtcttctcttttacctggcaaccctactagaggtactagttgccttcagtttcaatcttttcttgattacttttgtgatgcattgaattaaatttgattagccatccttaacacagcatctagattcagctttttccactatgcaaatcaggtagtatagtcattcatactctttccatcttctaaagtattgttgatgtatttcacctgctttcttttgctctctaatctctatgtgttagagaatatgtaccttcttatttatttactgtctttttgttggaatttttggagggagtg

SEQ ID NO: 70855 - DNA, 386 bp, Homo sapiens
acttggtcatcctatccataataattcctttttctgataggaacattttcacctgcaagtaaatagaaaacttgaccaacaaggccttaaacagattggggtttgtttttccttgcacgacatggttcgtttgcacagtggttccagcaagggccaggctctgtgtgtttctgctctgccattctaagcagcaagtggttctcacggttactgaatggctgtcaaggcttgaagtcattgtgtccattgcatttgagtcaggaagaagaaaagatactgttgtgttcctattgttgtttatctagaaagcaaaagtattcctagaggatgcctagcctgtctccctgtatatcttattactgacaactggatcatacttctggcaa

SEQ ID NO: 70856 - DNA, 371 bp, Homo sapiens
gtgggtgacagtcctgaggtgtgctctgacgggatggtcatagaacactctatatgcttccttatttgaagaaaattataattaaaggagacaaaagtaactacctctttttttatacttgacttgcaggtgactatgtatctttctcttacattaaacacaaaaacctgaatgactttccagatatattgttggaagttttcaaataacggcatttgtaacaatcatgtactgttaatgactcgccattttatcttactcatttgtaacacagtggttaaaaaaacacaggctttgtctggatcagactacctggattcaaatcttgcctatgccattttttgcctgtaactgtaagtgaattacttaac

SEQ ID NO: 70857 - DNA, 372 bp, Homo sapiens
gtcaaaactaaatttcaattttatgtttccttaaatttctaataagtatctacatgtttttgggatcagccatataatttactaagctaaaattaaataaattttttaaggatagacaatggttataattctttgatgaaagtctgtatgaatctgggcaagttacttaatttgtttaacattcagcttttttatttgtaattgggtataatagtgccttctcataggatcattgtaaggatttcttttactctttctttcagaattttgaagatcaagtgtaattatagcccagattctgttgcatctgtggttattctagatctctagggttactggagtaaattattcgttatacctcttccagtcctg

SEQ ID NO: 70858 - DNA, 813 bp, Homo sapiens
tggaatgggagtgtttacccaattcctgtacccccactgtatgttggaagtaactaactgtttttttattttgtaagctcacaggtgggagagacttgccttgtctcaggttgagactctggactttggacttttgaattaatgctggaatgagttaagactttgagggactgttgggaagatataactgtattttgcagtatgagaaggacatgagatttgggagacaccagaggtggaataatatgatttggatctgcatccccaccaaaatctcatgttcaattgtaatcctaaattttggaggttgagcctggtggaagaggattggataatgggggtggtttctcatggtttaacaccatccccctgggtgctgttctcatgacagtgagtgagttattgtgagatctgattgtttaaaagtgtgtgccacctcctcccactttcctcctgctccagccatgtaagacaggcttgcctccccttcaccttttgtcatgattgtaagtgttctgaggcctccccagccatgcttcctgtacagcctgcagaactgtgagccaattaaacctcttttctctatatattacccagtctcgggtatttctttatagcagtgcaagaatagactaatacagggttcaattcagcaagaggatataacaaatataaatatatatgcactcaacactgcagcacccagatatataaagcaaatacgattagagctaaagagagagagtgaccccaatacaataatagctggagacttcaacaccacattttcagcactggacagatcttccagac

SEQ ID NO: 70859 - DNA, 193 bp, Homo sapiens
tctatcaacctggctagagcttttatattaagaaaatgtattgagttattggaatttagtgtcatgccttgtacacatccagtgtttctcattaaatctgaattgctaatctgaggtcagtattaagtccacagaaagttgtgcttgttagagaatcacagaataatgtagtttatgagagagcctactaaga

SEQ ID NO: 70860 - DNA, 216 bp, Homo sapiens
gcagtggcactgagttgagaactgttgcttgctttgcattaaataggagatcagtccctgcagcttgtgggaataaggctttaaatctctccaattttagctctgtgagatggcactggggaaacagaaatgaacggactagtgtcacaaagctcaggtgggatggacgagatcacttcaaaggtctgtaatcccacgtctataatcccagcactt

SEQ ID NO: 70861 - DNA, 439 bp, Homo sapiens
gaccggtcgagtcagacctcacgtgtagactaagaggatcaaaagaagagtacgttacctgcggcgccggttgtgcgcagaccagatgtgccgggagctgcaggaggtcagaacctaagggagacggcggaagaaaatggagcgtcagtgatcatcagactagaatgagagtgaattgggagaaaatggtgcggccccctcacccagagaaccctcccccacctgctcacacccccagcgaacaccccgggggaggcctatgaagcagcagtaaaagaaaagggaggaatataaattctcaagttggaagggacccggttaccacttcctttgctttctgaactttttgttttggtctcctgcgggcaggagtgagtctcgccatcccccttgcttgcttgcttgcttgcgttcagctaagagtcatcttctctcctct

SEQ ID NO: 70862 - DNA, 662 bp, Homo sapiens
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgttactataatagattcctttaagcagaaagtct

SEQ ID NO: 70863 - DNA, 399 bp, Homo sapiens
actgctgctactactcaggaaatcaccacaacctgagggcctggcaagaattggtggttaccacccaggtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgtt

SEQ ID NO: 70864 - DNA, 511 bp, Homo sapiens
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaataataaaacagtaaatcctcaaaaaaaaaa

SEQ ID NO: 70865 - DNA, 620 bp, Homo sapiens
ggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaataataaaacagtaaatcctcaaaaaaaaaa

SEQ ID NO: 70866 - DNA, 631 bp, Homo sapiens
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgtt

SEQ ID NO: 70867 - DNA, 682 bp, Homo sapiens
ggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgtt

SEQ ID NO: 70868 - DNA, 545 bp, Homo sapiens
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaataataaacccgggtgcggcaaggccccctccccctttcgggtaaatgaatgaatcacaattagg

SEQ ID NO: 70869 - DNA, 1182 bp, Homo sapiens
agccggagtcagaactgcgtctcgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggccgtggcctctagctccctctttgacctctcagtgctcaagctccaccacagcctgcagcagagtgagccggacctgcggcacctggtgctggtcgtgaacactctgcggcgcatccaggcgtccatggcacccgcggctgccctgccacctgtgcctagcccacctgcagcccccagtgtggctgacaacttactggcaagctcggacgctgccctttcagcctccatggccagcctcctggaggacctcagccacattgagggcctgagtcaggctccccaacccttggcagacgaggggccaccaggccgtagcatcgggggagcagcgcccagcctgggtgccttggacctgctgggcccagccactggctgtctactggacgatgggcttgagggcctgtttgaggatattgacacctctatgtatgacaatgaactttgggcaccagcctctgagggcctcaaaccaggccctgaggatgggccgggcaaggaggaagctccggagctggacgaggccgaattggactacctcatggatgtgctggtgggcacacaggcactggagcgaccgccggggccagggcgctgagccctcgtgctggaatggttgtctggtatctgaactgagcctgctggctggaccaactgtcctcgaaaagacacagctggcttccctagtacagagaacagggcttgggccactttggagagacagaatctagtcctgggcaacttcacatccgtcctcctgtctcagggctggcagggggagcctggaattaccccctagtgatggaatgacagggtctggtggggactgaattccctggccctggggtcatagcttgggctgttccttctctgatacgggaagagaccccaatcagatttttcaaattaaagccagtcctgggaaatctcaaa

SEQ ID NO: 70870 - DNA, 385 bp, Homo sapiens
agccggagtcagaactgcgtctcgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggttcaggaacatggtggtctggccttgtaggtacatatttgacctgtcaatgtttaagctctaggaaagcatgagcttaaaagagccggaccttgggtacttgatgatgtccttaacgcttttgcggattttcagatttaaatttgaccg

SEQ ID NO: 70871 - DNA, 1369 bp, Homo sapiens
agccggagtcagaactgcgtctcgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggccgtggcctctagctccctctttgacctctcagtgctcaagctccaccacagcctgcagcagagtgagccggacctgcggcacctggtgctggtcgtgaacactctgcggcgcatccaggcgtccatggcacccgcggctgccctgccacctgtgcctagcccacctgcagcccccagtgtggctgacaacttactggcaagctcggacgctgccctttcagcctccatggccagcctcctggaggacctcagccacattgagggcctgagtcaggctccccaacccttggcagacgaggggccaccaggccgtagcatcgggggagcagcgcccagcctgggtgccttggacctgctgggcccagccactggctgtctactggacgatgggcttgagggcctgtttgaggatattgacacctctatgtatgacaatgaactttgggcaccagcctctgagggcctcaaaccaggccctgaggatgggccgggcaaggaggaagctccggagctggacgaggccgaattggactacctcatggatgtgctggtgggcacacaggcactggagcgaccgccggggccagggcgctgagccctcgtgctggaatggttgtctggtatctgaactgagcctgctggctggaccaactgtcctcgaaaagacacagctggcttccctagtacagagaacagggcttgggccactttggagagacagaatctagtcctgggcaacttcacatccgtcctcctgtctcagggctggcagggggagcctggaattaccccctagtgatggaatgacagggtctggtggggactgaattccctggccctggggtcatagcttgggctgttccttctctgatacgggaagagaccccaatcagatttttcaaattaaagccagtcctgggaaatctcaaaaaaaaaaaaacaaaaaaaaaaaaaaaaaaaaaaaaaaaaaaaaaaaaaaaaaaaaaaaaaaaaaaaaaaaaaaagaggggggggcgccccaaaaaacccccgcgggggggccccaaaaaacccccccctttagaaaagggggccccaaagggcggcaaaaaaaggcgcgccttaaaacacgacgaga

SEQ ID NO: 70872 - DNA, 457 bp, Homo sapiens
tgcactaatcatggggaaatggatggcacagaaaatggtgagcttgtccccctccttccctgtctggtcaccgcaccccgttcctttcctcttcctcgtttcttttttttcttaatcccataaacacagtaaagccatttcttagtacctgttttgtttcctgattattccaggattctctcactagaccctaagcctctcattctgctgtaggtcagattctctattccttctccctagcccagagccttgccagcacttgcgaaagttacggttagaacgttcccttgcctagtcacctctttgaaaaaaacactgtgatgttacatgactgcgattcaaatcagacactgtctgcttcccacatgtatctcagacaggttttatttaatgtttcttgtcagaatattgtaaattcaaaaggatgactttaaataaatgtaaacaaagacaaaaa

SEQ ID NO: 70873 - DNA, 352 bp, Homo sapiens
tttttttgagacagagtcttgctctggtcgcccaagctggagtgcagtggcgcaatctcggctcactgcaagctccgcctccccggttcacgccattctcccgcctcagcctcccaagtagctgggactacaggcgcctgccactacgcccggctaattttttgtatttttagtagagacggtttcaccgtgttagccaggatgatctcgatctcctgaccttgtgatccgcccacttcggcctcccaaggtgctgggattacaggcgtgagccactgcgcctggcaaaccatgcttgactttcaagaactctttagttatttctagaactttatctcctttagaaaaaagg

SEQ ID NO: 70874 - DNA, 351 bp, Homo sapiens
tcttataatatagtacctaaactttgtagtactctgaaaatatttgttgaattgaatgactgattgagcacctatgtgctaggcactgttgcggatgctatggacgtagccaagaacacggtctttaagaggcatgctcttatgaagtttatcttctagtgggagagacagatagtaaacaaataaacgagtcaacaaaagaatgtagggtggtgaggccgggcgcggtggttcacgcttgtaatcccagcactttgggaggccgaggcgggtggatcaccaggtcaggagatcgagaccatcctgggtaacatggtgaaaccccgtctctactaaaaatacaaaaaaaaa

SEQ ID NO: 70875 - DNA, 236 bp, Homo sapiens
ctgactccaacacaaactcaaatgccttcaagggcctagaatgggagaagtgcctgcagtaaccgggacaggacaagactaccctaaagcattcaattctaatttaaaatacagcaacaggctgggcacagcggctcacgcctgtaatcccagcactttgggatgccaaggtgggcggatcacctgaggtcaggagttcgagaccagcctggccaacatggcaaaactttgtctct

SEQ ID NO: 70876 - DNA, 86 bp, Homo sapiens
tgtacaacatcccaccacttggtattggaatcaatatgtcctgccctgcctttttacccttaggaataaatatgaaaaatggattt

SEQ ID NO: 70877 - DNA, 2414 bp, Homo sapiens
  misc_feature (1327)..(1327): n is a, c, g, or t
  misc_feature (2143)..(2148): n is a, c, g, or t
agtcttgctcccatcagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaanggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaannnnnnctgaaagttgtatttcatttttttaaatgtttaacaattacactgtatcaatagtatatatacgtgtacatatatataattcttaataactgcagtgtatctagcatatatataatggtggctggtacatgtttaatagcagactctggaggaggaatcctgacatacagcatttgccagctcaatgtaaatgctcatgctccctcatggtcaatttcaatctaccactggtttagtaactaggatgcaaaatttctaaaaatgtg

SEQ ID NO: 70878 - DNA, 2140 bp, Homo sapiens
  misc_feature (1327)..(1327): n is a, c, g, or t
agtcttgctcccatcagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaanggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctga

SEQ ID NO: 70879 - DNA, 748 bp, Homo sapiens
  misc_feature (477)..(482): n is a, c, g, or t
taatttctgtatttttagtagagatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaannnnnnctgaaagttgtatttcatttttttaaatgtttaacaattacactgtatcaatagtatatatacgtgtacatatatataattcttaataactgcagtgtatctagcatatatataatggtggctggtacatgtttaatagcagactctggaggaggaatcctgacatacagcatttgccagctcaatgtaaatgctcatgctccctcatggtcaatttcaatctaccactggtttagtaactaggatgcaaaatttctaaaaatgtg

SEQ ID NO: 70880 - DNA, 399 bp, Homo sapiens
caggctgctgagacttccctctagaatcctccaacatggagcctcttgcagcttacccgctaaaatgttccgggcccagagcaaagcttttatgcctttgaagtgaaggatgcaaaaggaagaactgtttctctggaaaagtataaaggcaaagtaagttgcatcatctgatttttattgttatcatttttccttgtctctgtttattcctcttaataaaatcaattttttgctgttacatggtcataagttggaatttagtcttcagagtaatggtattagtacatcactttagttattacagttctgatagtttgcttctaaataataaattccgattatctcgttttctttaaaatgctttaattttgtgctgaattgacatgtaaagttgtttgg

SEQ ID NO: 70881 - DNA, 1207 bp, Homo sapiens
caggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatcctta

SEQ ID NO: 70882 - DNA, 1121 bp, Homo sapiens
caggctgctgagacttccctctagaatcctccaacatggagcctcttgcagcttacccgctaaaatgttccgggcccagagcaaagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatcctta

SEQ ID NO: 70883 - DNA, 1054 bp, Homo sapiens
caggctgctgagacttccctctagaatcctccaacatggagcctcttgcagcttacccgctaaaatgttccgggcccagagcaaaggtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatcctta

SEQ ID NO: 70884 - DNA, 1338 bp, Homo sapiens
  misc_feature (1067)..(1072): n is a, c, g, or t
caggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactcttgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaannnnnnctgaaagttgtatttcatttttttaaatgtttaacaattacactgtatcaatagtatatatacgtgtacatatatataattcttaataactgcagtgtatctagcatatatataatggtggctggtacatgtttaatagcagactctggaggaggaatcctgacatacagcatttgccagctcaatgtaaatgctcatgctccctcatggtcaatttcaatctaccactggtttagtaactaggatgcaaaatttctaaaaatgtg

SEQ ID NO: 70885 - DNA, 1179 bp, Homo sapiens
aatgcttttttaatggcagtactatttcagggccttaacccaggcatctaggttacagttttcaatagaactgtgtatgtccaaaaatatgaaaaaaacatcaatcagaggttatagtcccccccaaattgtttaggattttaactacttgcagaattttttaaaatcttttgcttcactttccggttggatttttttctttttccgggaggtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatcctta

SEQ ID NO: 70886 - DNA, 873 bp, Homo sapiens
  misc_feature (801)..(801): n is a, c, g, or t
  misc_feature (858)..(858): n is a, c, g, or t
  misc_feature (871)..(871): n is a, c, g, or t
caggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaaaagaattccacttgatcaacttaattccttttctttatcttccctccctcacttcccttttctcccaccctcttttccaagctggttcgctttgcaatatattactggtaatgagttgcaggataatgcagtcataacttggtttctnctaagtatttgagttcaaaactcctgtatctaaagaaatacggttggggcattaatnaagaaaatctttntt

SEQ ID NO: 70887 - DNA, 1367 bp, Homo sapiens
caggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttc

SEQ ID NO: 70888 - DNA, 1064 bp, Homo sapiens
caggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactcttgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctga

SEQ ID NO: 70889 - DNA, 577 bp, Homo sapiens
atttattctttaaaaacaaaaacagcatgtatcattttaacaacaataataaagtaattatttaaaaaaattatatctgcaacttagggaatcactaaagccaaacgtctgatttgtttaggttctgtgggaatcatcctttggcgcaatcacgtgcattcaagcattattacgtttaggaaatggtccaaggggtatgtgcagttcctgaaagtctttttacagcctgtatattctctttcgtatcttttaagtttcttgtttgagaccttcctctagacttctctagaatcctcttaacctctctggcttttgaggggttttgtagaaagccattgcctggcacagagaagttatccatcctggaaatgactgccagagtctaggccaaagggtgtaggtcttttccactctgcctctgcatagttaagggtgtttacatctgaacagaagatgcacttcggctgcactaaagatacaagcagtattaagggaagagtagctgttgtcttttcagcacccaggagtaaaaagtaaagattaaggtgacacgtgcactctctgtgaagaactactt

SEQ ID NO: 70890 - DNA, 560 bp, Homo sapiens
tattctttttaaatgcgtcgacgtggaggggaaggattaaagttagggattggagtattttaatgctagaagggagaagaatgattggaaggcggaaaaagtgattgctttttacctttttcttcagaaggtcatgtgaccagctctgagtaaaactgcttgagagtaattgtgcttgttgattagatgatagttttcttatcgtttccactaaataacatgcaaaacgactcccttctactgtttttctcgatgtatttcttctaataatacatgatatttttgtagtgaaagtttatgaagtcacaacttacctgtcttttacagctgagtgaacttagcaagattatgtggcttgttcagagtgacacggcttgttaaaaaaatatagccgaagactagagattggttttctgacatctagatctaggttgatttcacctcttagagattccagtcttggaagagggttggtgcaggagaggactggagattaagtatgaagaaagttaggaaggggattaaacgcccctggagatgttaaaaaaaaaaaagtcgac

SEQ ID NO: 70891 - DNA, 315 bp, Homo sapiens
ttttcagtcggacatttgatgtctgttgctgaaacatgcaagatcaatatgtgttcagcttccggcaggtttcccatagcctgcccctacaggctggggaaggcaaagaatgctgcccccagctttcacacagagagtacagaagggaagggcttttcctatcttgtttctgaaaaattcccttaaacaaaagagaaataaaggggggaggaaagtataatgatgaaaatttaacaagtatatacaaggagaagagggagaggaagacagaaacaatcagggaggaaaggggagttattttccccaaagactgct

SEQ ID NO: 70892 - DNA, 656 bp, Homo sapiens
aaaaattaggtatgtcgtaggcataaaatatatgtacatgctagtcttgtatcatttactaccataaaatacacacaaatgtattatactaaattaaaatttattaaaacttatgcatacaaatgcttatagactatatacatgataccatttgcagtaatgtaaacaataggtaaagaaatgtaaacaaacataaaagctgcagtattaaatcataattgcataaaattaactctggtacatactgtactactgtaataattttgtagccacttcctgttgctattgcaatgagctcaggtgttgtgaatattcactgaaaactccatgtgacactaatcatctctgcttgagcagttaatctcttcagtaaatagtgtatctcagtaaaaagtgatgtctcagttttcatttatttttcgtcatatttaatttacaatactgtaaacctggaataagtaataccatgagacccataggaagtgccaccagtggtgctggaagtgctcccaagaagcagagaaaactcatgacattacaagaaaaagttgaattgcttgatacgttctgttgtttgaggtctgcagctgtggtcacctgccagttcaggcagacaattgactttgtaaacagatgacataaacttatggtatcaa

SEQ ID NO: 70893 - DNA, 503 bp, Homo sapiens
  misc_feature (407)..(407): n is a, c, g, or t
tgagaattgcagcttatggccacacatcagacatactgacttaaaggggccagaccctggtgaaatgaaaagtgagttaggcatgtgagcacttgccttggcttccagaaaactaagtaatcaagagaaatactattttgatgcagtattttaaaaaaatcaaaattaatgcaaaaaaaaaaaaaacccattgcaagatgagcaaaagatcaaatttttttttagtatgtataacttgatttaattttatttatttttaaaatattttgcatatttttcttaaactacggcacttagtattccaaggaggtctcccatctaagtactaaccaggcttgaccctacttagctctttttttttttaatttaattttattattattatactttaagttttagggtacatngtcacagtgtgcaggttagttacatatgtatacatgtgccatgctggtgtgctgcacccattaactcgtcatttagcattaggtatatctcctaat

SEQ ID NO: 70894 - DNA, 648 bp, Homo sapiens
cctgtgtttaatttgtttgtagttgactgcaaggcctctgaggcacgggaattcacagctgagttcttggagaaggtccttgagccatctggatggcggacagtctggcacatgatgtgctcaaggtgctgcttgaggccacagatgtggacatttcagccttgaaggcagtggtgcagcttgctgagccatacctctgtgaatcttgagcgagtactttcaccttggagtgtgtgaaagagctcctcgagctgaaggaacatcagttgcccctgaaggagctgggtggtgtttgatgattctggagacagcacttgtaacttgtaactgagcatgtcagctaggaaggaggtatctggtcagagaaggtgttttctgaggctgcttcctggatccctagggtttgtgttcctgccattcagcctatttggcagttatttccacctgtacaaacagaccctttgtcccttacatgagaaagaaagcccacacctggattcatattaataggatatggtctaccaattaatattgtgatagaaaagagggaaaaaggtgacacttctgtggactgcatgaatgaggatattaacatctcaggcataagatttgttcagcatggtgttataaaagaaatcttaaatgtct

SEQ ID NO: 70895 - DNA, 852 bp, Homo sapiens
gcggtccgcctgccgggagggggcgcttggcggggcggcggggcggggctctcaccggtacgagctcggccgcccgtccaatcagaggcgccgcgccgtccgcgggaatttgaagtgcctgactgggtggccgggagacggagtctcggggtcgcgtgcacctgggcggccagggaggctccagtgcccgggagaaaggcaagaaaactgaggcacagagagattgtcacacagccagtaaggtttctttcaaaatgaagattcacgcagtgattgtaactgtcttgatgagccaggttgtagtttacaaagttttattccagaaggaaaaaagccacttcacctagaaattttgcaaacaaatcaacttttactctgtgagtaatccagggcctatcaagactacattttagttgactgcaaggcctctgaggcacgggaattcacagctgagttcttggagaaggtccttgagccatctggatggcggacagtctggcacatgatgtgctcaaggtgctgcttgaggccacagatgtggacatttcagccttgaaggcagtggtgcagcttgctgagccatacctctgtgaatcttgagcgagtactttcaccttggagtgtgtgaaagagctcctcgagctgaaggaacatcagttgcccctgaaggagctgggtggtgtttgatgattctggagacagcacttgtaacttgtaactgagcatgtcagctaggaaggatagccactgagcaagcctgtaaggctattggtctgcccattctggtttcttcagcaatgcacaagacctgggacctggggcacgttgccagaacgcatccaagggcacctg

SEQ ID NO: 70896 - DNA, 2352 bp, Homo sapiens
gcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70897 - DNA, 3329 bp, Homo sapiens
gcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggaaaaaaaaaaaaaaaaaaaaaaaaaaaaaaaaaaaaaaaaaaaaaaaaaaaaaacaaaaaaaaaaaaaagcggggggcggcgcgcccaagaaagagatctctccgcaggggggagccccagatgatgcgcgcagcgccccacgtttttgtgagtcacagagagggggcgcccaccaaagaggagcgcagtatataatgagagccagagagcgggggcgcgcgtataacaacagccgcggggcagcggggcaaaccgaggcaccacgagggacacctgtgggagagacgacacctcatccgcggaggggggagccaacacaagtgggccaacaacgcacccgagggcggaaatttaaagcgcccggagggagccaagtagagaaacgtgcagaggggggataataaagaggtggtgttacaacactgggggagataattctgatggtcgggggctgtgaaagaaaagaatggtggcacgtaggggggaagaactgtgcttggggagaacgagagttttattagaagagggggggtgggtagagtgagaaaagagagtgggtggggggtgtcggggctgagtagtggactgtgtatggtgaggtctgcgcgcgttctttcgtgggtgtctcgcggtatccgcgctgcgaccgccgcgggggcgcctgagagggagtcgcgacagcaacgcccgtcgtaaaggcggggcgggtgcgcgcgccgactagacggagagggccccgccgcgcccttgacgacgtacagggccgcgggacgcaggtaggacgcgcgaagcacgatgacgaaagaggatcgagccgcctgtggcgcgcagtgagcgaacagtgtctgtgatacggccgatgatccgtggcagacagccgcgcggcggcgaggggaagtacgattgagatcactgcctggctctagtcgtgttgtgtgccggtgcgtatggagtgccgaccaccgctgcaacagcc

SEQ ID NO: 70898 - DNA, 2084 bp, Homo sapiens
gtgaacgtccggctttcccttgcagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70899 - DNA, 2190 bp, Homo sapiens
aattccctccgccgcggtcgctgagcgagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70900 - DNA, 1430 bp, Homo sapiens
tgaggatccccgtctctccacactgtgctctctccatcactggatcctgaaggaacggctacatggagaagactggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70901 - DNA, 1075 bp, Homo sapiens
gcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagaaccgaagcttccgaagcgctgtcacatgatgacgcagctcatgtactcatgaccctgatctcgccgag

SEQ ID NO: 70902 - DNA, 1028 bp, Homo sapiens
gcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggtgggtgctggcgagcactcgggcccgggtggcacaggagggtgggccctcaggcccgggtggcgcaggaaggtgggtgcttggacggtacgggagggtaggcacttgagctaggcggcatgagaaggcgggaagtcgggctgggcagcgtgggaaggcgggtgcttgg

SEQ ID NO: 70903 - DNA, 2321 bp, Homo sapiens
aattccctccgccgcggtcgctgagcgagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70904 - DNA, 2242 bp, Homo sapiens
gcgccggcactcgctcagcgaccgcggcggagacacgagcggcggcggcggagcccagagggcggcgggaatgcggaaccggcgcgcggggcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatgg

SEQ ID NO: 70905 - DNA, 1593 bp, Homo sapiens
gcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatcgcgatcgttgtctcccacggaccagccgtgttcctcactacgggtcttccg

SEQ ID NO: 70906 - DNA, 392 bp, Homo sapiens
ccttccaagaacctgcccaggaagtgggtacacctgtccccacccccacagtaggagtcagaatcagggactggaagggatggggttcctggaggaagctcacagcagcagcagcctctgagtcacaactcagcccctccctggcatatccctttgtttgctgggagttgagctgtgactcacaaaggctctggtcccgggctgggcccatgtgacccagggtcctgactgccctgcccacagtcactgagaaaattctttgtgcaggctcaccttcccctcatctcccccactcttcctgatcctgcagcgtcagatcccagcctgcagtatcagacctcaaaaggagcctctggtgtcttgtgagtagtttacctgccgccccaccccca

SEQ ID NO: 70907 - DNA, 1053 bp, Homo sapiens
acagtcactgagaaaattctttgtgcaggctcaccttcccctcatctcccccactcttcctgatcctgcagcgtcagatcccagcctgcagtatcagacctcaaaaggagcctctggtgtcttccaaaagggaaggaaagagagagaaagccactggagttgggcagcgtgggaagctgtgaaagtggacaagcgtgaaagagcttccaagtagtggaaacagcagaagcaaagatgtgaacatgggaaaacctctgcagtatctgggtgactgtggggtttggctctgtttgagcaccccgggatgattggtggtggggtgtggctgaaggtgaattggaacagtgcactcagagccaggttgcaagagtgctgcatgctcctcagggattggctccggccaagtgccccagcctccttttctggagaattctgtttttgacttgggccccatgtccagttctgctctgacttgtgggtccaccttagaaaagtcaggagacacctgggaaatgaaggcactagactcttccagactcgttccatggccacccagaggccttgggtcatccacccaacatcccaacaaaccccactgtgcactggcatcatgccagggtccaggtgtcctgccaggagcagcctctgccctcccagagctgacatttcagggggatgtgtgccaaagtgagacctgtcagagatatttacaagcagccatctctcttgacatcgctgtatcccaaataaatcttctgggaagaccctcttcacctccagctctcctgatacagcaaggcagttgtgagcaagttattcataactctacacctcaatttcttggtatggaagatggggataatgagaggaccacaggatggttgtggagactgtgtgaggatatagatgccgagcccagtagcacagggtgcagccgttcaaaccaactgacatttactgagggctgctttgtcaggtccctctctacagtatactccaacacacacatacacacacatctgtaatcaataataatcctgcaacatctgaaaa

SEQ ID NO: 70908 - DNA, 1513 bp, Homo sapiens
atacttgctttgtttcttgtaactgatttctttagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagctaaaggactatggagtggatctcattgaagtttcaggcaatggatgtggggtagaagaagaaaacttcgaaggcttaagtaagttaactttttctaatcctattataaaataattgggccacatgtcttagaattttgagtaacactgtcttgggaaacacaaaaacagttttttaaagccagttactagatatcatgtatatttgttgttatagcacttaagatatcttagtccttactttatactctctttcagctctgaaacatcacacatctaagattcaagagtttgccgacctacctcaggttgaaacttttggctttcggggggaagctctgagctcactttgtgcactgaggtgataaaatatttttatccattcacttgacccttagaaaaacctctctgaaaattaattggaatcattattatttacagttttctgtctcaatatctcagcttccagcttcttgaattctgttttgtctcactgccaatctaagtcctagtacttctgaaatgtgagcaataaatgaatgaaatgaagcaaatagtattgttaaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattatatgcacacacatacacagctaaattagaaaacacaattttaaattttatataattactagttattaatgggtaaaattcatttttcttttaatatctaaaatattatttatgccccgaaatatgctaataaaagttaaagattgtgtattatgcctagattcaaagtttttggcaaacttcaaatacttttgattgacatgtacattagcagttattagttgacttttactaaaacatgcacctttacgatggtgtttttgtagaaacataagtagtcaaatagtaacatttattgcagttttgtacagtatttgagtatagtgcataaataggtatgttcataaaatcaataaaaggagtatctatggaaataagcaaaatatcagcaaaaattgctattcctttgcctcatttaatttttaaaatttctttgtttccatgtgattctattatatgcctttggcatgccttgtataaaaccaaggtcacaaatgcaacttattaacggaatttgccaagaagacagccttgacattaaaaattccctcacaagaggtaatccataatccttaataaaataaaattgttacatgagccaat

SEQ ID NO: 70909 - DNA, 375 bp, Homo sapiens
cctgatgctgttgtagacccaaagaatactaacgaactgctccctaatagttaggcagaacttttaggcttacatagcatcaagtagtcttttctaggtatctaaacgctacaacccctaaagacatgaatggaatggagaagaacccagtagctccagacattggacacagtatacattcttctttgaatctgtgtgatattttgaactctgtgttgagctcttcacatcttgaattaaatgaggaaattaattgtgttgatatacctaatgctaaatgacgagttaatgggtgcagcacaccagcatggcacatgtatacatatgtaagtaacctgcaattgtgcacatgtaccctaaaatttaaagtataat

SEQ ID NO: 70910 - DNA, 418 bp, Homo sapiens
caaataaacacatacaggaggtcccgaaggcttctaagaaagaaaacatggtagacatgtaaatctaatgcctactttatctaaaactctatgacaataaaagaatcttatattttagaaaacacatactctatccagtgtactactatgtcatttaattcaccaatatgcctatattaaactatatatcaaaacacttttttaaagatattaccaaacatacataaccttgtgtctccctaccctgactttagctaatggctcactgacttaagtctcattttcaaagcaatattttctttcactcatctgttctatgcaacttatgtatctataggtgatgatagcatttgtgaaaactttttgctattcataagcaagaaaacaaccgtaattttcattcttccaatttcaagta

SEQ ID NO: 70911 - DNA, 3293 bp, Homo sapiens
gggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagctcaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatgctgtaaatacgctcgtcctgccagcagctgagctgggtagcctctctgagctggtttcctgccccaaaggctggcattccaccatccaggtgcaccactgaagtgaggacacaccggagccaggcgcctgctcatgttgaagtgcgctgttcacacccgctccggagagcaccccagcagcatccagaagcagctgcagtgcaagcttgcatgcctgcgtgttgctgcaccaccctcctgtctgcctcttcaaagtctcctgtgacattttttctttggtcagaggccaggaactgtgtcattccttaaagatacgtgccggggccaggtgtggctcacgcctgtaatcccagcactttgggaggccgaggcggcggatcacaaagtcagacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaaatcgtgctcgtagcagctggctctgtttcgagtcaggtgaattagcctcaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcaggacccaaccctagaagggcccaaatgagagaatggtacttagggatggcaaaacgggcctggctagagcttcgggtgtgtgtgtctgtctgtgtatgcatacatatgtgtgtatatatggttttgtcaggtgtgtaaatttgcaaattgtttcctttatatatgtatgtatatatatatatgaaaatatatatatatatgaaaaataaagcttaattgtcccag

SEQ ID NO: 70912 - DNA, 2943 bp, Homo sapiens
gggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagctcaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatgctgtaaatacgctcgtcctgccagcagctgagctgggtagcctctctgagctggtttcctgccccaaaggctggcattccaccatccaggtgcaccactgaagtgaggacacaccggagccaggcgcctgctcatgttgaagtgcgctgttcacacccgctccggagagcaccccagcagcatccagaagcagctgcagtgcaagcttgcatgcctgcgtgttgctgcaccaccctcctgtctgcctcttcaaagtctcctgtgacattttttctttggtcagaggccaggaactgtgtcattccttaaagatacgtgccggggccaggtgtggctcacgcctgtaatcccagcactttgggaggccgaggcggcggatcacaaagtcagacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgagccggccggttgcgcgggccctcggaccctcagagaggcgagggttcgagggcacgagttcgaggccaacctggtccacatgggttg

SEQ ID NO: 70913 - DNA, 1287 bp, Homo sapiens
gggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcaggacccaaccctagaagggcccaaatgagagaatggtacttagggatggcaaaacgggcctggctagagcttcgggtgtgtgtgtctgtctgtgtatgcatacatatgtgtgtatatatggttttgtcaggtgtgtaaatttgcaaattgtttcctttatatatgtatgtatatatatatatgaaaatatatatatatatgaaaaataaagcttaattgtcccag

SEQ ID NO: 70914 - DNA, 429 bp, Homo sapiens
attttctggtattgaaatgttatcactccagaattcactttattatgtagcatactttttaaagcagaaaatattaacttttctatgtgacagaatatagtcttaaatatgatagttactattttctttagttgtttgtgttatcttcagaaagataatttcaggtttcatcagttctttgttatagcaagcattttattaattcttgagcatcaatcagtgtgtcacgtcctacaactgccagtgttttgccattcggtattttgttgaaaagtcttggtgccagtaaaatatatgtttgcttatttaaatattttgtgagtcttactcaaagaaaacatacttcacctttcatctaaatccttaaaactagccatttgtactgatgtaaaaatgaaaacattgaaggaaagattgcagcatatggct

SEQ ID NO: 70915 - DNA, 579 bp, Homo sapiens
tggtaaatattttcctacctttcaagccctactaatagaatttacagctaaaaaactgaggttaaaataaatgaacaaatcttttcaaggtgacaaacccagggagtggcagtgctgatgaaaaaacagatgtgtctgactcatgtttcaagtcaggccattcaatcacttcaaacagtcttccacccactcctgctcacttatgtgctcaagaaccacccactcaggagataccacactatgccccagtgactgtcccacgggcatttaactttgcaagttcttacgccatctcactggggtcagtgtttttctttttctttttgtcttttgggatactattttttctgtcacaaatgttccacttttttccactattttactttcactatagttatttcactatttttctgcccccttagacaatccagaggcaaaaattatttgttttcccctcaatgccacagtctgattggttgaccagcaatgtgtctccaagaaatgaaagctgggttgggtgaagacaattttaacatctcaaggggttacgtcgacgcggccacgaatttagtagtagta

SEQ ID NO: 70916 - DNA, 1171 bp, Homo sapiens
tcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccat

SEQ ID NO: 70917 - DNA, 571 bp, Homo sapiens
ttcccccaggctggagatgttgagtttatctgaatttttctcgtgtcttcctgctcctccttccttgtaactctctcgcctgcagcctctgttatttcttcctctgaaggtgcacccaggcttacttatctaccctcctccctgggccatgccctgcacaccatacctcagtcatgtcatcctggattctgtttactgtcagtctttctgtttggcataggcatccctcttggctggcctgtgaggacagcccctttcctcatttcatgctcctaatggagaagccactgcaagatatttaatgtccttcacctgattttccatggccacgcaaaacctggacacaactcagccacccactgacttctttcctgcttctcatcctcaaatacccttcattgggctgttgtttcttttgaaaacatcctcccatgagggattccacagtgattccccagaggaaccacagagttgggatgaggacagtgcaagtgtgagagtgctgggtgtgagggcactgggtgtgagggcaccaggtgtgagggtgctggttgcgagggcaccaggtgtg

SEQ ID NO: 70918 - DNA, 550 bp, Homo sapiens
gtgtcgcagagtaggaaaggaggccagccagcaggggtccgacacgtggcaggaggagggcagggccagagtgctgcaaaggtagtgactgccgcggaagggaggtttgttgggatgtggagtcccgaggggagaggaagggagatttggactttaaaagaacctagaagaggatggaattgttaaaacaactggaatatttgctcatttaacaagcctttgttgaatattttctccgtggaaggcattgtgattcttttcttgattcagtggatattacttggctcctagtttgtaccagacactgtacttaggcattttgagatatccaaaaatgttcgtcctctgagaggttatactgtagttggggaacttacatagctagggcagggagtgtttgcgccgccagccatcggcagctgggactcgatgttgctggaatgtaactgttacagaggtgctaacagtgaaaaaggtacacagctacatcagatgagaaatataagttacagtcatctttgttctgccacagtgccaaatgacaattttg

SEQ ID NO: 70919 - DNA, 408 bp, Homo sapiens
gtctgtcctttcagttcttgtaattttcttaccattctgtttggaagcaatacagtagaagggagccatatacacctggaaagaccttggataaattcctcaaacaactgatctttactttcctcatctatacaatgacataagagtggtgtctggatcctccactgttattatgttcaaatgcaatggtttctgatgctaaattaaatacagcctaaagctgcctcctcacatattttaagttcagcctaaaggtttctccctaccttaacctaacgggatgtataaactgtaacctaactggatgtgtaaacagactgtaacctacacttgcaacaaacaggcaagtaacaatttgctaattgttctttgctcaattaaaccctgttaaattcaatttgtttgaag

SEQ ID NO: 70920 - DNA, 2910 bp, Homo sapiens
agcagagcggacgggcgcgcgggaggcgcgcagagctttcgggctgcaggcgctcgctgccgctggggaattgggctgtgggcgaggcggtccgggctggcctttatcgctcgctgggcccatcgtttgaaactttatcagcgagtctcgccactcgtcgcaggacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagtagtcgggaatctgcctttgtttatgccatctcctcagctggagttgtatttgccatcaccagggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatctgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcatattatgcatgtgacccatggaatctcataactgaaagacttgaaggatgaaaattttggggatacaagattggtgaactaaaatgctgacagagaggtttccagagctaactcgtgcctggggcggccttacaataagcagatgcctgaaagaagtcggccacgtccgccgtctgctaatgcccatcacccttcaagcccagtttaaagacctgtcatatttaattgtatttatttgatgcttacaagatgatgtgatactgtagcctaaagcaaatgacacatagcattgcttataaagttggtaaccctgctatattatattgcaaacaaatcgtaacttggagactatgtttaagggactcaactgtaattatgggagcatcagtatgcaaatagtggttggcttctgccatcagccaaaagatgacattcagggaaaatggagaggctgcctgcaccgtttttttatgttaaatgaaagaaaggtgaaatagctacttctcgtcttcttgaaaaatttggttcttattctgtatatgacttccttacagtgctacattaacaggatatttcattacatgcatctggtatcaaatta

SEQ ID NO: 70921 - DNA, 2846 bp, Homo sapiens
agcagagcggacgggcgcgcgggaggcgcgcagagctttcgggctgcaggcgctcgctgccgctggggaattgggctgtgggcgaggcggtccgggctggcctttatcgctcgctgggcccatcgtttgaaactttatcagcgagtctcgccactcgtcgcaggacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaaggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatctgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcatattatgcatgtgacccatggaatctcataactgaaagacttgaaggatgaaaattttggggatacaagattggtgaactaaaatgctgacagagaggtttccagagctaactcgtgcctggggcggccttacaataagcagatgcctgaaagaagtcggccacgtccgccgtctgctaatgcccatcacccttcaagcccagtttaaagacctgtcatatttaattgtatttatttgatgcttacaagatgatgtgatactgtagcctaaagcaaatgacacatagcattgcttataaagttggtaaccctgctatattatattgcaaacaaatcgtaacttggagactatgtttaagggactcaactgtaattatgggagcatcagtatgcaaatagtggttggcttctgccatcagccaaaagatgacattcagggaaaatggagaggctgcctgcaccgtttttttatgttaaatgaaagaaaggtgaaatagctacttctcgtcttcttgaaaaatttggttcttattctgtatatgacttccttacagtgctacattaacaggatatttcattacatgcatctggtatcaaatta

SEQ ID NO: 70922 - DNA, 2051 bp, Homo sapiens
agcagagcggacgggcgcgcgggaggcgcgcagagctttcgggctgcaggcgctcgctgccgctggggaattgggctgtgggcgaggcggtccgggctggcctttatcgctcgctgggcccatcgtttgaaactttatcagcgagtctcgccactcgtcgcaggacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagtagtcgggaatctgcctttgtttatgccatctcctcagctggagttgtatttgccatcaccagggcctgtagccaaggagaagtaaaatcctgttcctgtgatccaaagaagatgggaagcgccaaggacagcaaaggcatttttgattgggttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatctgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcatattatgcatgtgacccatggaatctcataactgaaagacttgaaggatgaaaattttggggatacaagattggtgaactaaaatgctgacagagaggtttccagagctaactcgtgcctggggcggccttacaataagcagatgcctgaaagaagtcggccacgtccgccgtctgctaatgcccatcacccttcaagcccagtttaaagacctgtcatatttaattgtatttatttgatgcttacaagatgatgtgatactgtagcctaaagcaaatgacacatagcattgcttataaagttggtaaccctgctatattatattgcaaacaaatcgtaacttggagactatgtttaagggactcaactgtaattatgggagcatcagtatgcaaatagtggttggcttctgccatcagccaaaagatgacattcagggaaaatggagaggctgcctgcaccgtttttttatgttaaatgaaagaaaggtgaaatagctacttctcgtcttcttgaaaaatttggttcttattctgtatatgacttccttacagtgctacattaacaggatatttcattacatgcatctggtatcaaatta

SEQ ID NO: 70923 - DNA, 243 bp, Homo sapiens
cgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtaagtccacgcgcacgggcgcgggggattttggagatcggaatggggaccgcattggccacatagacccttcc

SEQ ID NO: 70924 - DNA, 336 bp, Homo sapiens
tgtaaaataaaatataaaatataactgaagtggcttatcttcttagttctgattctaaaacacagttttctcatgtattacctcacctctatacaaagtgtcaatggattaaaaaaagattccctgaatcttcttcccctgggcctttcttttttatcttatgactataagaggatgaagattcagggaatcggggaaagggaggttaggttccttaagagacactagaaattttgttgcgcttgcaaaccacaatttagagatcgctatttatgaaaaagaaagagaagtgataagtcatggaaaccttcacctgtggtgctacttgttctgtgg

SEQ ID NO: 70925 - DNA, 1099 bp, Homo sapiens
  misc_feature (29)..(29): n is a, c, g, or t
  misc_feature (69)..(69): n is a, c, g, or t
ctgcgcagtcccaggcggtgttaataaanaacccacgaagaaaaagagctttagtgtaactgcaagcanacttcttgagatggaaggattgtcatctgaggaaaaaaaatcaagattaagagaggaggaactagaatgagattcacataccgtctctcctccaagggaaggagagagtggtgatgcctgcccactccttcctgggcagaacatttgtagcatggaacattggagaatttgcagtctgctgactttctgatttaggaggttgatggggaggccttataatttgcatttctaacaagttctgaggtgatgcttcaagtatgtccaggcagaagggctgcctcacagagaattctgccataccacatgggaattgaagtcacagacatctctaaccctcaagcctgaaaccaaaagactgaaaaccaacactacagtggacaaagaacatctctgaacttgtgtggggaccagtgacacaaggacctaaggtctctctcttctcatcttggcacttcagaagtctccccaatcttgacaaagccctggagaaagggccgggcctcccgttgataagaatatcactgcagataaatggaggtttcaaattgaaagaaaggaggagggcctcctgttgataagattattgtcactgcaggtaaatggaggcttcaaatagaaatacatttcagttacagaaaaaaaaattatctttgttacacatttgagtttgcaggcctaaggttactcccgctacactatcatctgtaaccataacgcactcaacattttaagctaactataaggattgttgcttcactcaaagatcctgaggttttattcactaacatttttatttggtgactatagttgacaagaacaaagctgtggggaaccaacaaacactgcaatgcctggcattgtcacctcactagattgtgagttcctctgggacagggtccgtacattttcttagaatccctcacttagccattagcctgcacagtgcttgtacttagtaagtgctcagtaaatgtttgtggaatgaatgcatgatgaacaaaatatatactgaggactcttaaaaaaaatt

SEQ ID NO: 70926 - DNA, 250 bp, Homo sapiens
ctaattctattaatattattctaggtgactctgaagcagaactcttgagatggaaggattgtcatctgaggaaaaaaaatcaagattaagagaggaggaactagaatgagattcacataccgtctctcctccaagggaaggagagagtggtgatgcctgcccactccttcctgggcagaacatttgtagcatggaacattggagaatttgcagtctgctgactttctgatttaggaggttgatggggagg

SEQ ID NO: 70927 - DNA, 3416 bp, Homo sapiens
  misc_feature (1)..(1): n is a, c, g, or t
  misc_feature (323)..(323): n is a, c, g, or t
  misc_feature (357)..(357): n is a, c, g, or t
  misc_feature (712)..(712): n is a, c, g, or t
  misc_feature (1247)..(1247): n is a, c, g, or t
  misc_feature (1432)..(1432): n is a, c, g, or t
  misc_feature (1502)..(1502): n is a, c, g, or t
  misc_feature (1651)..(1651): n is a, c, g, or t
  misc_feature (2433)..(2433): n is a, c, g, or t
  misc_feature (3028)..(3028): n is a, c, g, or t
ntagacaggagcctcaggaaatgcagacgcctctctcccaaatcaaattttaaaagttgtcctgagttgacctgtggagggtcaggtaggaatataacaaggttgcaggaagcagctaatcacagacctattttccatcatttgtctatcactaagtcattaggtcctaactgtatgataggcactgcaagaggcgagtgaatacaaagacaaaggctggcaagggaccctcagccagggggagagaaactgatgggcatgcggttgtgacacatgcaatgagaaggctagtggaggaaaggcagaaggtgctttggatattnagagaggaagtgaccagccacggtgatggcaggnagggcttcctgggtgtgatactagagctcagagttcaaggatgagtagaaggagttagccaggtaaagaaggtagggggactggaggcagagaaaacagacagggaagagcaagacacattcagccaaatacaaatagtctggtaggatcagaggtagcatgggggctggcatggtggccctcaacagatgaggctggagaggtgggtcatgaagtgtgccctgataaggaataggattctttttttttttttttttttgaaatggagcctcactctgtcatccaggctggagtgcagtggtgcaatcttgactcactgcatctcccaggttcaagcagttctcctgtctcagcntccccagtagctgggactacaggctcacgccacctcgcccagctaatttttgtatttttagtagagatggggtttcaccacattggtcaggctggtctcgaactcctgacctcaggtgatccacgtgcctcagcatcccaaagtgctgggattacaggggtgagccaccacacctggccaggaataggattcttaccctgctggagtgtgagtgtgagggggagtactggcaggctcaggacctggtggctagagggtgtattggagagaaaccagagtgaaaaatggacaaccagccaggagagtagcagagagctccaagggaaagttgacagcctggaccaatgaaatgccaagtagggtgctgtggaggaggtaaaacgccctgattctctcatagcttggatatgaagagaggcgggcagaagatgaagagtctaggatgatccccctggctcagacatcaggctagcaagatggcaacagcatattcagaggccaggaacacagaggcatgagtctgagaccagagcgnagtgggcaaggtcactgatttccttctggttctacggtgaattatctgttggctgtgataatgcgcttccaagctgctgtactggcgggagacttagtcatgcattcatatgaggtcctgcaatgttaagagaacctccataaaaatgttagggagaagggcaggggttttggctttgcaaaacntgggtgtttccccagataattattcttactttagttctcgaaaatattgtgtgctgccattcaaaagtancaaccttttcacgggtgccaaactgtcagacattaactcaattcagagcaaaaagttgcagagaatgtagggggaaggtgcagtgagcaaagagctgtccatgctggtaggagcctaaagcacagccacaaccaagtcatttccagaantgttttattacgagcttgaatttgcacaccaacttctccaaggcagcttccctgtgagggagaagttagctagtgcctcggggtccctttaaggtttaaggcttggagtccttgactctcaggtataattcttgggatattctatgagaatgctgacagacaactttttaaggccaactttctgtcttcagccatgtgtgattctgttacatagaccagtatactactggttttagttcctgtgtcttgatggagcataataaaaatctcaaaattaaagatccattttattcaataccatggactttaaaagtgaataatgttttatcagtgcacatcatatttttcaaaatcatcaacattttcattgggtggagggagtgttcccttcaaagcatactaaacaaccaatacattgggattagaaggttcaaagtagcattcttccccggacaacctacatgctttgctgttcttatactcctgcagtatgttcatgaatactctgcagaaagttgcttttttttcttctactatgtgccgctttcctaatgaattatgtagatgaacagataacttttgagttaactttcacacttagatttattctttcccagaccatagcgggtgttttgacgtaagtcctgcagagctagaaatttaacttcaaatttgcaaaaactattttcaaccaactttggaccccacagtgttcattaaatgaattagaaattacagagttagggggtttttttattttattttaactgttgccatatctngatccattgcctaaaattcatacaaccagaaattttggtagaacttcctacactcttcaggcacttcctggcctgttgtagtttcttcaacagactgcgcagggccctgtgttaaatgtgtcaatgtttacttaatactgacatgcaaaagctcactctttctctttctttttctgctgttgtagtaaaccatatatagggaccaaaaattaattggaaatcctgaatcttgctctgtcgcccaggctggggtgtagtggtgcgatctcctctcactgcaagctccgcctcccgggttcacgccattctcctgcctcagcctcccatgtaactgggactacaggcgcccaccaccacacccggctaattttttgtacatttagtagagacggggtttcaccgtattagccaggatggtctcgaactcctgacctcgtgatccacccgcctcagcctcccagcacgcctgtgctgggattacaggcgtgagccaccatgctgcgctggcacagttttcttaaatccacattgccgaggcagtgggaggtccaagccaaataaggagcaggctttctctaatgtcattcccagtgcntttcactcccagagtctacaggtgctattccggcttatggctgttgaaatatggaacagcaaaccggctgtcattcataagaattggtgccggccagctggccaagccaactacaggaataaagacgtgccttttcactctgatacacggggccttgctctgagcagacagctgaagaatctcaggtgacaaccccagggaaatggtgtttgtggcactcaggcattcgccacgccgaagaggcaaagcaacagacataggatgtcagcgtgctgattaaggagaacagaggccgaccatgcctgctcctgggactttgggcagaggaagagaaactgaggggaaagcttagatgactacatgttataaataaactttaaataatttt

SEQ ID NO: 70928 - DNA, 682 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaagtggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcaaaaaaaacaaccacccacggaaaacaacaaaaacttccccagggg

SEQ ID NO: 70929 - DNA, 1721 bp, Homo sapiens
ccgactaagacaggacccccgtgttccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70930 - DNA, 1633 bp, Homo sapiens
  misc_feature (32)..(32): n is a, c, g, or t
gaacttacggctaggtacgaggctgggtgttngctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70931 - DNA, 1209 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccttgggctgtgttcttgctggtgagcaaagtgttgcctgcaaaaataaaatgcagaacgtactctaaaaaaaaacacagtttttt

SEQ ID NO: 70932 - DNA, 1139 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggtgagtgccacaggaggaggaggaggacatggggtttgattctgtgcctttcagtgggtaatgaaggctgaaaggatgactttcgcttaagtctttcttgctgcaccaaagcagttcacggtatttgccccaagctaagctttccccactgcaggtgtgagatgtggatcccttagcccttggggcagagaccccaggccagttacctctgactgtgagccctttaaacgtaggccgtttcaatattgtgtgtcctggcttaacctgcatgttctggttggctgtgacaggcccttagctgctccatgc

SEQ ID NO: 70933 - DNA, 1537 bp, Homo sapiens
ccgactaagacaggacccccgtgttccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70934 - DNA, 1084 bp, Homo sapiens
ccgactaagacaggacccccgtgttccgtaaaggcgcgcgggaacatggggctgtatgctgcagctgcaggcgtgttggccggcgtggagagccgccagggctctatcaagggaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggtgagtgccacaggaggaggaggaggacatggggtttgattctgtgcctttcagtgggtaatgaaggctgaaaggatgactttcgcttaagtctttcttgctgcaccaaagcagttcacggtatttgccccaagctaagctttccccactgcaggtgtgagatgtggatcccttagcccttggggcagagaccccaggccagttacctctgactgtgagccctttaaacgtaggccgtttcaatattgtgtgtcctggcttaacctgcatgttctggttggctgtgacaggcccttagctgctccatgc

SEQ ID NO: 70935 - DNA, 790 bp, Homo sapiens
ccgactaagacaggacccccgtgttccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggagatctttgctttgactggtgccaagcggtggatcatggcagctgttgccgggtgggttctggggactggggggggtccggggcccctggttcgcctggggcc

SEQ ID NO: 70936 - DNA, 791 bp, Homo sapiens
ccgactaagacaggacccccgtgttccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgaggggaggggagggacggggaagtgaaccccgacggtcagcgctttgtcatctggtctcagctctgctgccgtgcacggcgggactggagcaagtcgctcatctgaaatgagtatgagccgaccttccctgggttacgaattaagatgggatgaaaatgctttaactttgagtgttttgaaggattaaataaccgaagtacaaagtggtagtggcggagactgtaaggaagtcgggcgtggcggcgcgcacctgtggtcccagctactcgggaggctgagggaggaggatcacttgagcccaggaggtcgaagctgcagtgagctatgatctggccactgcacttcagcctgggcgacagagctagaccccattctaaaaagaaaacccaaacccacgaaagggtaatgttggcaagaagttgggtgcagaggtgtctactggtgaacatcggtggagaaagggtctaaggctgggaagcgagacgccaggttccgatcctgttctgtagttaatttctggtgtgat

SEQ ID NO: 70937 - DNA, 571 bp, Homo sapiens
gaaggagttggggggtgggggaggcggggaactttgctcctgcctactcactgctcattgcgtcctacgtagcctcccagctgcctcgatttgtgcgtgtgaacactctcaagacctgctccgatgatgtagttgattatttcaagagacaaggtttctcctatcagggtcgggcttccaggtgagagcttagagccctggctgtcctcatctagggaggtgtctggggtattgggaagagaagtggctggatagttgtgactttgctctctgggctttcttcctacctttccagcagtttatccatctccaaggtttgtcttcctgccatcccttaaacatcgaactcctaggagcctcatcctacattcttcttgatctctccgttttttctctagctttaactcctgcctcccacctggtgattctcaccacccagtgtagacttcttccctcttgcattcttacctcctcaggttcatatgaacgcaccacagatgctaacagtcgctgcatttgtcatctttcctctcagactttacacctagtacatccccagttaaatctaaca

SEQ ID NO: 70938 - DNA, 1751 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70939 - DNA, 1681 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70940 - DNA, 1649 bp, Homo sapiens
tgtgtatttcattaccgggctggggttcgcttgtaacatacgtggtccgttgctctgacacatgtagcgcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70941 - DNA, 1356 bp, Homo sapiens
  misc_feature (25)..(25): n is a, c, g, or t
ccgagtattgtacgaggctgggtgncgctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70942 - DNA, 1505 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaacacagtttttt

SEQ ID NO: 70943 - DNA, 499 bp, Homo sapiens
tttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccaggtaagctggaaggagttggggggtgggggaggc

SEQ ID NO: 70944 - DNA, 747 bp, Homo sapiens
cggacgcgtgggtcgacccacgcgtccgcttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctta

SEQ ID NO: 70945 - DNA, 796 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatggcttcatgttgattgggatcccatccagaatagccatcaggcagatag

SEQ ID NO: 70946 - DNA, 642 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggtttgctgttgatttacagaaaggggaaatgagtggattaagtttttaaatatctgtcattaagatgctattatgagttaatatttgttaa

SEQ ID NO: 70947 - DNA, 458 bp, Homo sapiens
  misc_feature (411)..(411): n is a, c, g, or t
  misc_feature (413)..(413): n is a, c, g, or t
  misc_feature (417)..(417): n is a, c, g, or t
  misc_feature (421)..(421): n is a, c, g, or t
  misc_feature (430)..(430): n is a, c, g, or t
  misc_feature (436)..(436): n is a, c, g, or t
cgcttcagattacccaaatcaaccatgaaaagcctgaactagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgctncntggngatngtgtcctcnagatcngcctgacctatacgtgctgccg

SEQ ID NO: 70948 - DNA, 929 bp, Homo sapiens
tattagagctaggagggcctggggtgaatcggccgagaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggccatctgatggaggctgcgacttacgttccacggccgtattagtgaccctggagtcgtacggacccgagaagaaatcggggtagagttgagtggcctattttgcttctcaggccggtgggaccgcctgccgtgggggacacggtgtgcggcttgcgg

SEQ ID NO: 70949 - DNA, 302 bp, Homo sapiens
acttttacgcaggccacttttacgcaggccacttttacgcaggccacttttacgcaagcagagtgctggtagcatcccgtaattttgcaaatgatgctacatttgaaattaaggtaagaggtgttttactttgttaataattttttcacaggtacactctgatatacagttttacctttagaatagaacattttgatgttcatgcttagtcatcattttcttctaaatgttccaggatcagaagttcagagaagcttcacgaaaactagaatttattattagcagcttgctgttgttctgtg

SEQ ID NO: 70950 - DNA, 1453 bp, Homo sapiens
ttacggctaggtacgaggctgggtggtgccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctta

SEQ ID NO: 70951 - DNA, 4125 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccaggtaattatgtctcttaacttcccaaaaacagtcttattttcaaagtctttaatatttacagttgaatttctaaagaagtagcatattgcttattaggtgaaatagcaagtcctatggctagctcaaatttggttgacttatggccagattagagattgacctcttagcgttgtttcacaagagacttacgggggcacattcctgtgaaggagctcacctttgctctacatcagtgcttggcaaaggccctgtggtaaaggacctccccacaacctattgcaaaacaatacagacccattctcttggatgtccgggctggcagtgtcaaattcggataatagcgtctgagtcctaactcagtttctatgcttctcttgttaccgagtaatccccagtctgtggccagcactctgtgaagccctgttctagaggctgattcttaggtgctggttcactctggctatccagtgggcctgatagatttcatattgatcttttttccagtgtgttccttactgctagcatggccccaaagaaacaagtagtagttggtttgtcaccttccttagttgcaagagtatgatgcctgctacttctcctccaccacccaccccgctttccctcaccacccaaagctcggttttagaagaggaggctttctgtgctttatgaaagctttctgtgccaggcagagcagcagctgttagagatgatgaagcctggagaaagaagccaaatgaaaccccttttcgtaactacttccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70952 - DNA, 3317 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataagaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70953 - DNA, 3087 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctctttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70954 - DNA, 3267 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70955 - DNA, 3120 bp, Homo sapiens
tgtactagtataggagaggtcctaagatgtttgtaactggccagaaaacccagaaaagtccagggtatcatctggatggaacatctgaaggaaactaagtgactagagagtaggaaaagctggaaaggttgaagcacattagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70956 - DNA, 2805 bp, Homo sapiens
gctcgctgctgaccaggctctgccggctccttcggcctcgccgcaggaacttgctactaccagcaccatgccctaccaatatccagcagtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70957 - DNA, 4044 bp, Homo sapiens
ttcaccctccttaggcaactggtggtcccccgctctcgggaggtcaccatattgatgccgaacttagtgcggacacccgatcggcatagcgcactacagcccagaaccccgggttcaagcaattctcctgcctcagcctcccgagtagctgggaatatagttacgtgccaccatgcccaaccattttttgtatttttagtagagacggggtttcaccatcttgtccaggatggtctcgatctgtggacctcgtgatctgcccaaagtgctgggattacaggcgtgagccaccacgcccggccaggttttattttttaactcttgaatgcagaaatgttagtgcttactggttaaaatagaacatagtatttatatattactttagtgctttattgaaaatatcggaggtgggataaacagagagatagggttggaaggagagtttgtagcagcagtgtaatttctgtgtcagattctggccaggagtgaaaatgcagggcattaattagtatctcccctcatggatttctgtggttcctttctcggttgtccttaatgttaggtgcccctgggcgctgggattgctctagcctgtaagtataatggaaaagatgaggtctgcctgactttatatggcgatggtgctgctaaccaggtaattatgtctcttaacttcccaaaaacagtcttattttcaaagtctttaatatttacagttgaatttctaaagaagtagcatattgcttattaggtgaaatagcaagtcctatggctagctcaaatttggttgacttatggccagattagagattgacctcttagcgttgtttcacaagagacttacgggggcacattcctgtgaaggagctcacctttgctctacatcagtgcttggcaaaggccctgtggtaaaggacctccccacaacctattgcaaaacaatacagacccattctcttggatgtccgggctggcagtgtcaaattcggataatagcgtctgagtcctaactcagtttctatgcttctcttgttaccgagtaatccccagtctgtggccagcactctgtgaagccctgttctagaggctgattcttaggtgctggttcactctggctatccagtgggcctgatagatttcatattgatcttttttccagtgtgttccttactgctagcatggccccaaagaaacaagtagtagttggtttgtcaccttccttagttgcaagagtatgatgcctgctacttctcctccaccacccaccccgctttccctcaccacccaaagctcggttttagaagaggaggctttctgtgctttatgaaagctttctgtgccaggcagagcagcagctgttagagatgatgaagcctggagaaagaagccaaatgaaaccccttttcgtaactacttccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70958 - DNA, 2352 bp, Homo sapiens
  misc_feature (21)..(21): n is a, c, g, or t
  misc_feature (24)..(24): n is a, c, g, or t
gtggattgggtttgagcgccnccnttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70959 - DNA, 2279 bp, Homo sapiens
  misc_feature (42)..(42): n is a, c, g, or t
tgctgaggtgactctagaggatttcggaaacgtctacttgcnagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70960 - DNA, 2248 bp, Homo sapiens
gttgatgctatgaaactgggagtaaaggaaatgaagaaggcagaagcaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70961 - DNA, 2095 bp, Homo sapiens
aaacgccgcaatctgaagttcaggaaaaaattatcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70962 - DNA, 1621 bp, Homo sapiens
ggtggtacaggtccggaagtcatttggattttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70963 - DNA, 825 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggacccataagattataatggagctgaaaaattc

SEQ ID NO: 70964 - DNA, 395 bp, Homo sapiens
gcgcctaactgattgaagccctcaaacaagtagtgatgggttacttaatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70965 - DNA, 472 bp, Homo sapiens
  misc_feature (15)..(15): n is a, c, g, or t
tctagaggaccccanccaacatgaaatagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggacccataagattataatggagctgaaaaattc

SEQ ID NO: 70966 - DNA, 585 bp, Homo sapiens
tgtactagtataggagaggtcctaagatgtttgtaactggccagaaaacccagaaaagtccagggtatcatctggatggaacatctgaaggaaactaagtgactagagagtaggaaaagctggaaaggttgaagcacattagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggacccataagattataatggagctgaaaaattc

SEQ ID NO: 70967 - DNA, 154 bp, Homo sapiens
gtgagtggtaggtttgtggtggaactgtgttatttaggtactgaagtatggcttgtacttattgggctttaccctgccatatgtatcagaagagtttgaggctggtaatgtaattttcttttatttatttatttttttgagacagtctctctct

SEQ ID NO: 70968 - DNA, 302 bp, Homo sapiens
cacacccagccaattaaaaaaattttttttttactagagacatggtcttgctacgttgcccagtctggtctccatctccaggctcaagcagtcctcccacctcggcctcccaaagtgctgggattactctcactctcttaaaaccaggcaggtagggagatttatctcaggcttaaagattgccattgtctcatcaaagagtgtttggtgtgaaactttgaaatgaatatcaagattgtgtttttatttttgaataaggtttatagttttcatagttcttatttcatggaagaagattgaat

SEQ ID NO: 70969 - DNA, 1501 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctta

SEQ ID NO: 70970 - DNA, 731 bp, Homo sapiens
tgaaatatgcaatcaatacttgctagaaatgagaacagatcagtcaaccaataagaaattcgtgacaactcagaagatctgataagactacactggacgcttaataaagggcctgcgtttgaggccgtggattgccggcctgttcttccagtcatcgttcctaactaactaactgcctaccggttctgttttaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctta

SEQ ID NO: 70971 - DNA, 879 bp, Homo sapiens
  misc_feature (781)..(781): n is a, c, g, or t
  misc_feature (783)..(783): n is a, c, g, or t
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggcccctggggctgggatggtctancngtaagttttgggggacatgaaggctggggaattatttgggaaggtgtggtaaccaggcgaattcaggtttaatgggggttgtggaaatactgtttg

SEQ ID NO: 70972 - DNA, 3360 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70973 - DNA, 3474 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70974 - DNA, 3312 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70975 - DNA, 1501 bp, Homo sapiens
  misc_feature (1236)..(1236): n is a, c, g, or t
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaagaatttgatgtggaagtgaggaggagatggggatgtgccagttggcagggcggtctgagacacctgggcacgaccgggctaccccatttattccgnggaaccactcttgagtctcggtggcaccaggggccaacttaaaccaccatcaggggggaaggcgggagtacaccccgcggcgacaccaaggttccatgggtcgggagaaacacgtggaaacagaatggcgaccttcggtggggcgaacatgacaggcaagcttcactatcgtaaaacagcacttggcggagagagagtcttcattcatcacggagtacttcaacacatatttcgacgtgttttcgctcgtctctcccacttctgg

SEQ ID NO: 70976 - DNA, 3301 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacagttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70977 - DNA, 3279 bp, Homo sapiens
ttcaccctccttaggcaactggtggtcccccgctctcgggaggtcaccatattgatgccgaacttagtgcggacacccgatcggcatagcgcactacagcccagaaccccgggttcaagcaattctcctgcctcagcctcccgagtagctgggaatatagttacgtgccaccatgcccaaccattttttgtatttttagtagagacggggtttcaccatcttgtccaggatggtctcgatctgtggacctcgtgatctgcccaaagtgctgggattacaggcgtgagccaccacgcccggccaggttttattttttaactcttgaatgcagaaatgttagtgcttactggttaaaatagaacatagtatttatatattactttagtgctttattgaaaatatcggaggtgggataaacagagagatagggttggaaggagagtttgtagcagcagtgtaatttctgtgtcagattctggccaggagtgaaaatgcagggcattaattagtatctcccctcatggatttctgtggttcctttctcggttgtccttaatgttaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70978 - DNA, 2271 bp, Homo sapiens
tctagaggatctcccaaacaccgcaatcttgccagtgtggaatgaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70979 - DNA, 2309 bp, Homo sapiens
  misc_feature (72)..(72): n is a, c, g, or t
tactggggccttatttatacatatattatatatgttattacagggctgaccctcggaagcagcaatcttgcnagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctggggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatga

SEQ ID NO: 70980 - DNA, 449 bp, Homo sapiens
tattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaaggtgtggtggtgcatgcctgtaatcccagctacttgggtggctgaggcacaaggaggctcacagtgc

SEQ ID NO: 70981 - DNA, 675 bp, Homo sapiens
agtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggactttatggctgtttttaatttagtttcacccgatcttgattcttgaattagctatgtttatatttttagttcttttttattcaactcagatttgtcaagaaatgtaacctctaaattgtgtagtacctctccaatcataaattttcaaaaaaaaaattctactttccaaaaagtgtcttgaattctctgaaaaggcacattaaactaatatgaacatcagataccagggggaaataaatggcaaagtaataatcatgaggttttaggtcaaagactacattatatatattttttattaccttctagtagagacatcctcctgggtgcatttcagtggccttctccag

SEQ ID NO: 70982 - DNA, 564 bp, Homo sapiens
tttttttttgtagagaaggggcttgctatgttgccagggctagtcccaagctcctggacttcaaacagtcttccttcctttgcctgccaaagtgctgggattacaggtgtgaactaccttacctaaactcttctaaattagtctttttagtgtactatccacttcctgctgagactctgactgatttaagggataatcttgactctgctttatttatatcaaaaaatccacaaatgttactattttattattaatatgttaattgcagtatacttcacagctgatggagacatactagtagtattatgacaaatacaggtgaaacatactagatttgtctcaatctcacatttaaaataagttaatatttttaaaaagctctcaaggctggatggtacagagagaagaatatccctccagcagttggagaccccaagtcttctctttgccctgcccctgaccctgtttgtgtcttctctcttcattattgccaatgatcaggctggacctggtggtctgtcctacaaatctctctgccgccaatatttgataataattccaaga

SEQ ID NO: 70983 - DNA, 354 bp, Homo sapiens
  misc_feature (58)..(58): n is a, c, g, or t
tcaacatttagaagtgtgcctttgacaatggtgaagatgaaagaggacttctacatgntacataaaactaaaatctcagggagctcctctaatcaatgctctaggacaagtacccatttgatgcaatagattaatgcaaaatactttctttcaagggtaaatattatagtgggtcaaactacttcaatcccactttagaaaattaattatgtgaccagaaaattccttgctatcttaatcttgattttcaaggattattttgggattgtgataatttgtcaacgtttattcaaaagatgcagtacaaccagcatattcaagtaaatttaaattaaaaggatactataaagaaag

SEQ ID NO: 70984 - DNA, 401 bp, Homo sapiens
ggcctccatgcagcctcttcacctctcccctagcccaggacatgcttccctgacagcagctctccaaccaccattgtggcttttacttatggctccacgagtattagtacccatgatgagtggacactgcgacagtgctaaggtctccttgtagaggggacacagagtactagacagacaattacattagagggtggcaagggttacagcagtgacccaggctgcagccagcccaaaccacttcgtgagagccaacactatgcacttctcctcaactctgtggtcagtgacgtcaacttcatagatggaaaccagccatgggggcagtatttacaccacggaaatcagcaaactgcaaaccagggcttttttccccgttctgcaagttgttaaatgtttcc

SEQ ID NO: 70985 - DNA, 860 bp, Homo sapiens
aagaggtaggtatatataaaatggcttaaaagagaaagtagcaaaaataagtaattgttttgggggtgtggtaattaattggattttgctggcattcaactttgcttttccccctaataactaatcacttgggtaattttagtctttgtttagatgattcattaaagtaggtattacacgagctcaaaatggggcaagctctatgttgtcccttacagtgcatttttctacttggaagaaattagtgtaggagtcttcatgagatttgttttacatttccctgtctacctgttatgccatttttcacaatgagcaattcttggttcttgtcacataaattgtaaagattaagtcaggacttagtagttttctaccaaaagataaaattgggcaagatattaaaaatctgtgcttactatgcctcagatttgatttttgacattttgtggacattgttaagttttttaagcatcattttaaaagaaccacttagagtaatgacattttcattaacaataggaaaacatgtgaagacagtataattatctgctgatactcaataccttaaggtttttattatgtttcttcacatttttctttagagtctagatttcagcagcataaactgaaacattctgcttctgtcttagaaagtttatcatttaaatttatttttttaactcgtagaaagataatacatggggccaacagagtatttaacagtcttaatctaaatatgttggaaagatgaggatatttcttatactgtaagaattatttcccttttaatttagatatattcattattcaattaatttaaactaataaaataattttattatatgtgtgacttgataaaa

SEQ ID NO: 70986 - DNA, 415 bp, Homo sapiens
attcctgtacgcgtcgacgtctggatcttgaagcctgaacctgtttaatgtggcaggatatttaataagtatcctgctttattgctacaagagtttcagatagtttacatatatgaataaattgctgggcgtggtggctcacgcctgtaatcccagcaccttgggaggccgaggtgggcggatcacttgaggtcaggagttcgagaccagcctgaccaacgtggagaaaccccgtctctactaaaaacagaaaaaaaattagccaggcatggtggcgcatgcctgcaatcccggctactcgggaggctgaggcaggagaattgcttgaacctgggaggcggaggttgcggtgagccggaattgcgccattgcactccagcctcggcaacaaaagcaaaactccgtctcaaaaaaa

SEQ ID NO: 70987 - DNA, 809 bp, Homo sapiens
tgtacacaggcagtgagccaccacgtctggccaaaaaaaatttttttgagacatggtcctgctctgtttctaggctggagtgcaatggtatgatcacagctcactgtagcctcgacttccttgttcaagtgctcctcctgcttcaccctcctgagtagctgggactgcagatgtgcaccaccatgcctggctgattatagtatttttgaaattttcttctgcttccaatattatatctgtttccatccagttcttttcctttctttttttccccccatctgtctttgattttggaggctttcttcaaatttctgatatatgactgcctattcatatttaagggtaaagcactaaaatgctcattgaaagctctttggatggtctagatttgttgactggtagacttccctgtagggtaattgttatctacctggacttttgttggggtacctgaaatggcggtgttttggtaggtgttttttcgagtcatttactttagagaaaaatcctccaagttccttcatggaggatatgagtctagtgccagtgtactgagaacaaattcggggaagggcatatcgttaaggagggaagagacaaaaaacagaggacttggttgaaagtcagtaaaccaagcataataaggtgaagtcttgcttcctgaaacatatttcaggccagttgcagtggctgacacctgtccccagtactttgggaggccgaggagggagaatcacttgagcccagcggttcgagaccagctctggtaacatagggagacttcctctctacaaaaataaaacaagagg

SEQ ID NO: 70988 - DNA, 440 bp, Homo sapiens
ccatgttggccaggccggtctcaaactccggacctcaagtgatccacctcccttagcctcccaaagtgctaggattacaggtgtaagccaccacacccagcctcacgttttgagtttcatccagtcagaatacagacagaataagggtacccacacttttggagtatggacaaaagagagattctctagggattctcctccagtattaaatgtggttattgcccaaaagagcaacatagcactatgcataatgtcaatagatgagatttgtcttcaacaccaaagaggatttggtcctagagatcaaatgtggccccaactaccatgaatgtgtcacaagctccctttagacacactaaatgatacctggcctagaagactctgtaccttccagaatctaggatgacagacagctttcaatctcatcgactagctaaacc

SEQ ID NO: 70989 - DNA, 280 bp, Homo sapiens
tatcgtatctttatggttaaaatactataaaatggtgtgctcctatacatcccctcacaacacagcattcaacaacagcatgctggtagctcaaaaccaatcatgctgatagcatttacaccatggaaataggcaaatgccataaattaaaatttgctttattgttttaattgtctagaccagagactggcaaatctggccaaaaatttggcccaaaaagccaaatcctgtctcagagaattaagaattttttttttttttacgtttttaaaggttattt

SEQ ID NO: 70990 - DNA, 473 bp, Homo sapiens
ttaaaagaagtcaaaagttacaggaatcaaagccaaagtccctccagaagctaacatagtaataaaaccatcagtaattttaatgattgtttacatatagtgcctcctctaggtcaggcactttacttatgatctgttaattcctgtattaacctagtaattatacccaattttataagagcaaatattaaagctcaaggagagattacgtcatttgccagagttcacacagctaacaagtggaaaaacagatttgaacctgttttcctgactccaaagccagcaaagttctttcaactggagccagaaataccctaatgcccatgggtgaccagggtcccttctgggccatgtggtgtggagaatgagtttgaccaccccaaattgtcttgttcctcaagaggatttcccagaccttcaaggaataaagaaattgtaagtatttaaaatatattccttcttctaattgaaaa

SEQ ID NO: 70991 - DNA, 2334 bp, Homo sapiens
gtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacatcctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctatttagttttggcgagagaaagttgtttgtgtgggcctcccattccctggttaaaagggtcagagtctttgggaggctgaggcggggggggggggggaatcacctgaggtcaggagtccgagaccagcctggccaacatcgcgaaaccccgtctctactgaaaatacaaaaattagctgggcatggtggcaggcgcctgtaatcccagctacttgggaggctgaggcaggagaattgcttgaacctggaaggcggaggttgcagtaagccgagatcgtgccattgcactccagcctgggcaacaagagtgaaactccatctc

SEQ ID NO: 70992 - DNA, 1246 bp, Homo sapiens
gccgcgcgtgactgggcgtaatgcattcacaggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctatttagttttggcgagagaaagttgtttgtgtgggcctcccattccctggttaaaagggtcagagtctttgggaggctgaggcggggggggggggggaatcacctgaggtcaggagtccgagaccagcctggccaacatcgcgaaaccccgtctctactgaaaatacaaaaattagctgggcatggtggcaggcgcctgtaatcccagctacttgggaggctgaggcaggagaattgcttgaacctggaaggcggaggttgcagtaagccgagatcgtgccattgcactccagcctgggcaacaagagtgaaactccatctc

SEQ ID NO: 70993 - DNA, 1972 bp, Homo sapiens
gtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacatcctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtccta

SEQ ID NO: 70994 - DNA, 1719 bp, Homo sapiens
gtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctatttagttttggcgagagaaagttgtttgtgtgggcctcccattccctggttaaaagggtcagagtctttgggaggctgaggcggggggggggggggaatcacctgaggtcaggagtccgagaccagcctggccaacatcgcgaaaccccgtctctactgaaaatacaaaaattagctgggcatggtggcaggcgcctgtaatcccagctacttgggaggctgaggcaggagaattgcttgaacctggaaggcggaggttgcagtaagccgagatcgtgccattgcactccagcctgggcaacaagagtgaaactccatctc

SEQ ID NO: 70995 - DNA, 515 bp, Homo sapiens
tcaggtcactcgataaatgggctgaagtaacatacccagatgaggaatgtgttgcctccaaaatccagttaggcccactaggcattgtgcctctttcttggttgtaggaggggccaaatgcagcaacttatccttcaccttaggaggaatgtctcaacagtctctctttttccatttttctgccttcttatcttctagcggtattggcagctgattaggttgtgcccatccagattaaggttaggtctgcctttcccagcccactaactcaaatcctttggcaaccctcacagacatacccaggatcagtactttgtatccttcaatccaatcaagttgacactcagtattaatcatcacaccgccttcatacctttgttcacattgttccttcttataaaaatcacacaggagcatgcatacatacaggtgagagctttctgaatctttccagcccttcaaaacccaatactagttacatctattttgagactctttctgaccactccaatgtt

SEQ ID NO: 70996 - DNA, 391 bp, Homo sapiens
gacaggaccatgggagtctgctgtatgctgatttttactgtggctgactcagtactcagatccaagaccaattgccctggctgcaacttccagtacaatgttgaatataagtggcaatagtggacatcttgggaatgtcagcgtcctggtgaccccgacctctggcggatgtccttggtgttcacagggcagcaatgtgtgcttgggtacattgttgtagaaggacaacatggaaatacaacttgccagtgaacatgtttaatcctctcctatgttgtggtagtttttcaaataatttgtccatctcccctggcttatgactttttctcttactgatgcatagaggtctcttatgtaatctagttataaaagttgctgatatctccaccaa

SEQ ID NO: 70997 - DNA, 262 bp, Homo sapiens
cccaagctaagctaccacctttgcagagaccactccctcaatgtggagtgacagttcctcttcatcagcccacatctaacttctcttcaaaaatctgtctcaagatattcccttgcacaggagcccatacttcactaattatttcattacctcttgtcttacctccttcactctgtgtttttctgaatatttttgtgatcatattaacttgtacttttcttcacatagtttgcacatattatgcatgatattcccccatcct

SEQ ID NO: 70998 - DNA, 198 bp, Homo sapiens
acttgtttcatacagtgggtgagttaagaatggtgacaaaattgagaacactttgcctgaaaagcctaaaatatttaatttgcagaggaaagtttcccaacctcagtattagaactaaaaattaagtatactctgtgactcacctgggcgtggtggctcacgcctgtaaaaatacccgcactttgggaggctgaggca

SEQ ID NO: 70999 - DNA, 459 bp, Homo sapiens
tatttgtatattttaaattgcatgtacacgcatcctcatgtatccttctgaataacttaccatagaatatacacagttttgtacacttttttttacttggttttagattattattcaaaaattttacacagaaacatttacaaaacctaccccctacccccacacagaaatcatagatctaagttataattttaaactatgtggatttgtgtgtgagcatgataatatgttcacttgtatactttaagtataggaaattttaagggaaaaattacttgtttgaattatgatcatgatttcctgggttgctttaaatgatatggtttctgtcctgatcatatagtgaatctaggctcagtggtctaaaaatgatatttctttcatcactgtaatttgctttgcataatgcttatgcattcattctcataaatgcaagccattttattgcatattaaaaat

SEQ ID NO: 71000 - DNA, 787 bp, Homo sapiens
  misc_feature (761)..(761): n is a, c, g, or t
  misc_feature (787)..(787): n is a, c, g, or t
aaacaggcctggagaggctctgcgacccgcttaggaccacagaactcgagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcacgaggatctgattaacaaggtttctgacctaacgaaagacctatgtgcttanaacagcatttgtgggtttgtaacacn

SEQ ID NO: 71001 - DNA, 491 bp, Homo sapiens
  misc_feature (180)..(180): n is a, c, g, or t
  misc_feature (183)..(183): n is a, c, g, or t
ggtcgaccgatggctcacgcctgtagtcccagcactttgggaggccaaggtgggcggatcaccaggtcaggagatagagacccgcctggccagcaggcgaaaccctgtctctgctgagaatacaaaaaattagccgggcgtggtggcgggtgtctgtgatcccagctacatctgtggagnggncatcttcatgcacaggaggagcaagaaagttcaacgaggatctgcataaacggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaactcatatcaatacctccaactcatat

SEQ ID NO: 71002 - DNA, 1544 bp, Homo sapiens
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71003 - DNA, 1494 bp, Homo sapiens
tgcagcacctatttccaattgtgtatggcctcgagtaccaggtctcgcctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71004 - DNA, 1390 bp, Homo sapiens
aaacaggcctggagaggctctgcgacccgcttaggaccacagaactcgagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71005 - DNA, 1252 bp, Homo sapiens
ctccagactgcctcatcaggccgccccagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71006 - DNA, 1235 bp, Homo sapiens
tgtgctctcgacggactcccccttttgaggttgtggggtgctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71007 - DNA, 1458 bp, Homo sapiens
aacttgaggacccttcggactgcaggaattcttcacgagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71008 - DNA, 1483 bp, Homo sapiens
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71009 - DNA, 1396 bp, Homo sapiens
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccggagtaagacatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71010 - DNA, 1077 bp, Homo sapiens
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaatgcacaggaggagcaagaaagttcaacgaggatctgcataaacggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaaaaaagtcgacgcggccgcgaatttagta

SEQ ID NO: 71011 - DNA, 879 bp, Homo sapiens
  misc_feature (767)..(767): n is a, c, g, or t
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtctggcacggggggggggaaggccggctgattcgcccgnggtattgaccggacgtggggccaagctggggccatcatctgggaggggctctcatgcccgggatgagaagtcacgaggttgctaaccggtgcgcccccgaagggcttgacgc

SEQ ID NO: 71012 - DNA, 837 bp, Homo sapiens
  misc_feature (764)..(764): n is a, c, g, or t
  misc_feature (769)..(769): n is a, c, g, or t
  misc_feature (792)..(792): n is a, c, g, or t
  misc_feature (812)..(812): n is a, c, g, or t
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctaaggtgaacgtttccccctccaagaaggggcccctgcagcaccacaacctgcttgtctgccacgtgacagatttctacccaggcagcattcaagtccgatggttcctgaatggacaggaggaaacagctggggtcgtgtccaccaacctgatccgtaatggagactggaccttccagatcctggtgatgctggaaatgaccccccagcagggacgaagcccccagctcccgtcaatgtcttactccgggcagaatcagactgtgccttccactccacggtgacaggactntccangctggtgtgctccacttggcagntgtagacatctccctgctgnggggtcatttccagcatcgggtacc

SEQ ID NO: 71013 - DNA, 665 bp, Homo sapiens
  misc_feature (592)..(592): n is a, c, g, or t
  misc_feature (597)..(597): n is a, c, g, or t
  misc_feature (620)..(620): n is a, c, g, or t
  misc_feature (640)..(640): n is a, c, g, or t
cttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctagggtgaatgttgcccactccacagatgatgagccccagcacgaagcccccagctcccgtcaatgtcttactccgggcagaatcagactgtgccttccactccacggtgacaggactntccangctggtgtgctccacttggcagntgtagacatctccctgctgnggggtcatttccagcatcgggtacc

SEQ ID NO: 71014 - DNA, 655 bp, Homo sapiens
  misc_feature (582)..(582): n is a, c, g, or t
  misc_feature (587)..(587): n is a, c, g, or t
  misc_feature (610)..(610): n is a, c, g, or t
  misc_feature (630)..(630): n is a, c, g, or t
tttgctgctctattgccaaactactcatatccccctgtgtactgtgaaacttggtgaaattcctcagggatttggagacatcaaagcactccatgatggttctgcaggtttctgcggccccccggacagtggctctgacggcgttactgatggtgctgctcacatctgtggtccagggcagggccactccagagaattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgcggagtactggaacagccagaaggacatcctggaggagaagcgggcagtgccggacaggatatgcagacacaactacgagctggacgaggccgtgaccctgcagcgccgagtccagcctagggtgaatgttgcccactccacagatgatgagccccagcacgaagcccccagctcccgtcaatgtcttactccgggcagaatcagactgtgccttccactccacggtgacaggactntccangctggtgtgctccacttggcagntgtagacatctccctgctgnggggtcatttccagcatcgggtacc

SEQ ID NO: 71015 - DNA, 519 bp, Homo sapiens
  misc_feature (180)..(180): n is a, c, g, or t
  misc_feature (183)..(183): n is a, c, g, or t
ggtcgaccgatggctcacgcctgtagtcccagcactttgggaggccaaggtgggcggatcaccaggtcaggagatagagacccgcctggccagcaggcgaaaccctgtctctgctgagaatacaaaaaattagccgggcgtggtggcgggtgtctgtgatcccagctacatctgtggagnggncatcttcatgcacaggaggagcaagaaagttcaacgaggatctgcataaacggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaaaaaagtcgacgcggccgcgaatttagta

SEQ ID NO: 71016 - DNA, 738 bp, Homo sapiens
ttgctcgtctctttgcggaatggtgatttcatgcgcaggcggagtcactccagttcaccgagttatcagcataacgcggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacataagtgtttgctttcctttaaaaatatgcatcaaatcgtctctcattacttttctctgagggttttagtaaacagtaggagttaataaagaagttcattttggtttacacgtaggaaagaagagaagcatgaaagtggagatatgttaactattgtataatgtggcctgttatacatgacactcttctgaattgactgtatttcagtgagctgcccccaaatcaagtttagtgccctcatccatttatgtctcagaccgctattcttaactattcaatggtgagcagactgcaaatctgcctgataggacccatattcccacagcactaattcaacatatatcttactgagagcatgttttatcattaccattaagaagttaaatgaacatcagaatttaaaatcataaatataatctaatacacttt

SEQ ID NO: 71017 - DNA, 1733 bp, Homo sapiens
gcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaaaaaaaaat

SEQ ID NO: 71018 - DNA, 878 bp, Homo sapiens
gcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattgacgctagggaggccaggccgccctgggccagggactccacaatgacctccgccgagcccacctccagctctgcaggcggctgcagcgccaccaccaccatcttctcgtcctcgatgatcaggttgcggagcttgcgctgccgcgggttgtagttctctacccggtcgtggatctccatgtgcctccgcaggtgggcctgtcgggtaaacttgtagccacactcggtgcactcaaacttcctcacc

SEQ ID NO: 71019 - DNA, 1640 bp, Homo sapiens
gcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaaaaaaaaat

SEQ ID NO: 71020 - DNA, 613 bp, Homo sapiens
tgggattataggcgtgagccacagcgcctggcctgaagcagccactcacttttacagaccctaagacaatgattgcaagctggtaggattgctgtttggcccacccagctgcggtgttgagtttgggtgcggtctcctgtgctttgcacctggcccgcttaaggcatttgttacccgtaatgctcctgtaaggcatctgcgtttgtgacatcgttttggtcgccaggaagggattggggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactc

SEQ ID NO: 71021 - DNA, 662 bp, Homo sapiens
acagtggctacaggtgccaatcggctgtagtaggtgtggaggcagtggctgggagtggctcgcagcaagggcgagctctctggacaactccatgggtgacagaagcctggacacgggagaccttggggagccttatccaaggaggtgcttgaggctcccccttgaggaagacctctccattggtgggggaatttggagccaaagaaagctccttatgttgtcaaaatgtcccttttttaaccttaggatattgtgacccctgaaggtattaatgatattctagagcatttgaaagacaacagccaactagctggttaagcgcagctcagtttttccccagtgtgtgtgggtggctgagcacacattcattaattcagtgattcattcagccaacatctgcggaacccctgctggcttctggagtcagattgcggggatctgaatcgggcttgccacttactagtctatgacctcgagcaaatgacgtgattcctctaatacccagtttccccatctgtaatatgaaatgtgaatactaagtatccgcctcattgggttttaggagaatcaaatgcatgtcaagtgtttaacatggtgcctggcacagattaaacatccaagaagtgtgagttatgattaaaggctgtgaaatgtacaaagag

SEQ ID NO: 71022 - DNA, 439 bp, Homo sapiens
cttgaggcagtaagataaactcttgaggaaagagggctgtgggtatatttgtgtctcctgagtgcctggcaaacagccttgtacagggtaagtgcccggtatacaaataaaaattaagaaatgtatgtgtgggtcctccctgtttgagaagaatgcttactttttcaaacagattattcaccatggactttctttaaataggattttaaaatataattcaatttgccacatttgaattcacacataatttttcagtaacacagcaaatacataatgttagaaatatctgggatatgtctctggctatggaaaggacgagcagattgaagattagaagatcagaaggaggggaaaaaagcaagagattaagtttatgctttggtttaccttaacattgcttttccgttacttgtctatacagttcttttttctttccttt

SEQ ID NO: 71023 - DNA, 2060 bp, Homo sapiens
cttggctggaacctgagacggattcgctcccaaatgatgctccagtggctggagcaactcaagttcatcattgtcctgagagagaggagcagcgcggttctcggccgggacagcagaacgccaggggaccctcacctgggcgcgccggggcacgggctttgattgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaaatgtttggcactttgctactttattgcttctttctggcgacagttccagcactcgccgagaccggcggagaaaggcagctgagcccggagaagagcgaaatatggggacccgggctaaaagcagacgtcgtccttcccgcccgctatttctatattcaggcagtggatacatcagggaataaattcacatcttctccaggcgaaaaggtcttccaggtgaaagtctcagcaccagaggagcaattcactagagttggagtccaggttttagaccgaaaagatgggtccttcatagtaagatacagaatgtatgcaagctacaaaaatctgaaggtggaaattaaattccaagggcaacatgtggccaaatccccatatattttaaaagggccggtttaccatgagaactgtgactgtcctctgcaagatagtgcagcctggctacgggagatgaactgccctgaaaccattgctcagattcagagagatctggcacatttccctgctgtggatccagaaaagattgcagtagaaatcccaaaaagatttggacagaggcagagcctatgtcactacaccttaaaggataacaaggtttatatcaagactcatggtgaacatgtaggttttagaattttcatggatgccatactactttctttgactagaaaggtgaagatgccagatgtggagctctttgttaatttgggagactggcctttggaaaaaaagaaatccaattcaaacatccatccgatcttttcctggtgtggctccacagattccaaggatatcgtgatgcctacgtacgatttgactgattctgttctggaaaccatgggccgggtaagtctggatatgatgtccgtgcaagctaacacgggtcctccctgggaaagcaaaaattccactgccgtctggagagggcgagacagccgcaaagagagactcgagctggttaaactcagtagaaaacacccagaactcatagacgctgctttcaccaactttttcttctttaaacacgatgaaaacctgtatggtcccattgtgaaacatatttcattttttgatttcttcaagcataagtatcaaataaatatcgatggcactgtagcagcttatcgcctgccatatttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaagga

SEQ ID NO: 71024 - DNA, 825 bp, Homo sapiens
  misc_feature (251)..(251): n is a, c, g, or t
cctcacccctcccgcccactgcacccccccgctctctctccctctcactctccgcggtgccccgtccgggcctcctctcgcgcgcacgacgttcctcccgcccgcctacaagcgggcccacttccctcccgcttccgaagagccgataatccccttcccggctccgctatggatactgcgctcctgctgaaaccccccaaatttttttctcggcccctggcatttatccccgcgcacacccacctattttncggcccacgcccctcctgcaaaccgttttaggcaaactattgatttccccccttaccaaagccatgttttttttcccaggtcaaggattcggtccggggaccagccaaacccacgggtggagtaaacgcctccctataggggcacaggcccaaagatagccaaagcaggccaaactttgcaaagaaaaatctcatgggggatgacatatttggtataatttcacacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaagga

SEQ ID NO: 71025 - DNA, 726 bp, Homo sapiens
ttaaaaccaatgataaaacaagaattgccaaatcgaaaggttccccctcaccaatccgtgatttggtatcagaacacttctcactttggctctaagtgagactggcagcttccttgctccactcctgctcagttatttatcttcatctacgtgattgagaggaggtacccagccagtttcttccactgagtagtagaagttaggggccagaatgatagcttcgtttattttttgctcattgtctatcctagtctttcaccactactgttcataacatgaggcctttacagtagtacagcccatggatgtttgggttccttatcagtaggctatgaaacacaatgtgattttacccttagctgactctgggcctctggaaatagtcccaagccctaaaagcctctagcagcagcttggctccctctcatctttacaggaaaataattaacgaatgtaagtcttcttcacttgtgtaagacttcttgatagctctaaatattttgcttcttaattgcagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataat

SEQ ID NO: 71026 - DNA, 790 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagatgataagaagaccatggtctatcgaaagtactgtttgagcaaactaccgaacccaagaaggcaggtg

SEQ ID NO: 71027 - DNA, 746 bp, Homo sapiens
ggccagtgggcggggcctccttgaggaccccgggctgggcgccgccgccggttcgtctactctttccttcagccgcctccttttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacggtaaggtttggaaaagaagactaagaataagaatcattgcggccagcctgaccttggggcagaggatttggcaaccacctggcctcttattatcctgagtatttcctggaagtgtttgttactattgttattgttatagctgctattattattatattactatttaacaaataatttactcagtggtatagtgagatgggaatatcaatacatttgcctaattcttttaaatgttttaagtagtgtaaaatatacataacataaaatttaccattttaatcatttttaagtatatggtttagtggcagtagatatgtttacattattgtgcaaccatccatctccagaacttttgtctgcccaaaccgagaaactgttcccattaaacattaactcctcattccttcttccccctgcctaattcttttaccctcatttgtgcagagtagttgaccaga

SEQ ID NO: 71028 - DNA, 656 bp, Homo sapiens
atcttaccacatttgagggctacagcccacctctatcaataatagctgactcactagaggagttcttgtaaggggtggcaacaaatgagctcttagtgattgtgggggaaaaacctcttcgtgattgtgataacgccacctccaccctatagagaatactggctgtcagacattgtgagccaggcccttgtctttggaagtagccctctccatctctccccatgaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagaggtttgtaatctacctgtctcatcaatgaacataacctgaatgtactgttcagagccattcagcagctttctttggcagccacggggtagaggaaatgaaatgtagcctttgatgttacagtcctcaagcacctcctgtctagagtcatttgctctgctggtggccatcagggttagttaaatttgtttcctctccctgagatgcctcccttcttggtcaagaagcccttaaaaagaaaactggtatcttttccttgatgcctgtta

SEQ ID NO: 71029 - DNA, 2947 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71030 - DNA, 3248 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctgaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71031 - DNA, 3150 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71032 - DNA, 3331 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggcacccagtggcaagtactagctgagcatttgggagatgcttgtcttacttggctgttgcttctcctgctgctggggaaaaggaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71033 - DNA, 3081 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71034 - DNA, 3855 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaaaaaaaaaaaaaaaaaaaaaaaaaaaaaaaaaaaaaaaaaaagagagggggcgcgccgcgcccacaagagatcccccccgagggggcgcccccacaccgcgcgcccccccgcacttgggagcccaagggggcgccccctaagggggcactccttatttatatcaccgccacgcggaccgcgcgcgcgagcgccgcgggtttaaaccaagcagctgaaagagggagagaacaaccgcggcaccccgctgagaggaacaacctctctggacaagaggagaccctatcactctcggaggggggggcacaacaaataggcgggacaaacccacacctaaaagaaatatatacaacaaccaccacaaaggggacaaatataacaacacttctccagcgggcagtcaaacgaggtgtgaatcaaaaccaaacccggcacaaactcccacgcacagctcaacaacaaacatctcagcgcacaaccacgagagcacacacagctcactcagcaaaccacatattatcaaccccggggggcgggcccagcaacgaacaaacaacgagccaagggcaacatacacacacggcacacacgccaaccccgcgacaccgccaccacaacaagccgccacccacccaccccagcgtctgagcgtggagcgtagggacggggcgggtgaaggagagagagacggcgacacgccggggggcgcccgcctagcataatacggccgccaccgaccaaaagcaaccagacagaacagggcaacgaacagacaaatgagaccgagacaagacacacaaagacacacagccagaagccagggagaagacgggcgtacggagcggaggagcgccaaggaacagcaggccagacacaaatgcggaagaacaacgggagcctgaaaacacacg

SEQ ID NO: 71035 - DNA, 3048 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaaaaactctcactggccgtggtttacaacgttgtgactgggaaacctggggttaccaagttaatcgctgcagattccctttcgcagtggagtataggggcggc

SEQ ID NO: 71036 - DNA, 2936 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcagttacatctagagatcaataatcctccctcct

SEQ ID NO: 71037 - DNA, 3433 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggcacccagtggcaagtactagctgagcatttgggagatgcttgtcttacttggctgttgcttctcctgctgctggggaaaaggaatgcatcttgtcttgttcttgcagcccggcatgccagtgcttcctccacggtaaggtttggaaaagaagactaagaataagaatcattgcggccagcctgaccttggggcagaggatttggcaaccacctggcctcttattatcctgagtataatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71038 - DNA, 2899 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71039 - DNA, 2646 bp, Homo sapiens
cctaggtggaggccgcgcgttaatcggccgaggcggtggtcgggccatatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71040 - DNA, 3169 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtaaagcagaaggatattattagctcttctcattccccttcttcattgcctttctctaatctcagacacttaatgctgatccggcatttatagagatgcgtagtgaagggaaggaatcagcagagttctgctgtataaatggattgggttgacctctcttgggttttctttactcagatgttgctgtccttttttatttttctccttccttgtccttgctggtgttctgagcactgtctctttttccacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71041 - DNA, 2221 bp, Homo sapiens
gcctcgtgccgattcggcacgagggttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71042 - DNA, 2893 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71043 - DNA, 2634 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagggcatactcggactcccaccccacaaacccatctttattatgtgggcgcttaactcggaagaccgctaattcaaagtgtcccgggttacactctttgcccggatgtcagagggaggtcccgaacagacggggggtaaaaaggccccggccgtcaaatgcttataatttccctcggaacaatcacccgggtcacaagcttttgaaaacgcgcccaccgtgtcactggctgtttaacagta

SEQ ID NO: 71044 - DNA, 2217 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71045 - DNA, 1634 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttca

SEQ ID NO: 71046 - DNA, 1088 bp, Homo sapiens
aagtggatagtccaagtgtggggctgactgggaaagagtatattaaaatgggtaaatgggtttaccacaatcatatatttgggactctgcctcatgagtactgtgcaatgcctcaggttgccaccggcaggttgaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71047 - DNA, 1266 bp, Homo sapiens
  misc_feature (10)..(13): n is a, c, g, or t
  misc_feature (15)..(15): n is a, c, g, or t
  misc_feature (49)..(49): n is a, c, g, or t
  misc_feature (1185)..(1185): n is a, c, g, or t
  misc_feature (1193)..(1193): n is a, c, g, or t
  misc_feature (1200)..(1200): n is a, c, g, or t
  misc_feature (1203)..(1203): n is a, c, g, or t
  misc_feature (1208)..(1208): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacggtngtccaggnatggcangcnactanagaagatgtccggaaaaaccgtagggaaagttgtcgaacctggtatgacccggtgagg

SEQ ID NO: 71048 - DNA, 528 bp, Homo sapiens
tataaggatcccttctctgataccacaccatggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71049 - DNA, 976 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacaggtgaggtacaggcgcgtgacctcag

SEQ ID NO: 71050 - DNA, 592 bp, Homo sapiens
tctagaggatcccagtggccatacaggagagaagcaggtttcccacaaaggatgaggaaaaaaatagtcagtgtgaattagacatgctaggtcatagaaatgggaggctacagttggaagaccacagccccagtacctgataatcagggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71051 - DNA, 630 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcactcttttgagagccaaaaaaaacctcgtgccgaattctt

SEQ ID NO: 71052 - DNA, 1207 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtaaagcagaaggatattattagctcttctcattccccttcttcattgcctttctctaatctcagacacttaatgctgatccggcatttatagagatgcgtagtgaagggaaggaatcagcagagttctgctgtataaatggattgggttgacctctcttgggttttctttactcagatgttgctgtccttttttatttttctccttccttgtccttgctggtgttctgagcactgtctctttttccacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggaggtaggaaatttgggtggggtgatcggtgtgtgatggggattcaaaggacttgagtgtgaagggagggaaaaaatacagaatctttagaaaaattacctctgagttaatcagaaactaacttaacagattttcattggaggcttgttttttgtcagttgttggaattacaaagctaagtagagcatggtttctatcaccaggactgtttgtttggttaggctgacacacgtgcag

SEQ ID NO: 71053 - DNA, 848 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagagaatgcatcttgtcttgttcttgcagcccggcatgccagtgcttcctccacggtaaggtttggaaaagaagactaagaataagaatcattgcggccagcctgaccttggggcagaggatttggcaaccacctggcctcttattatcctgagtatttcctggaagtgtttgttactattgttattgttatagctgctattattattatattactatttaacaaataatttactcagtggtatagtgagatgggaatatcaatacatttgcctaattcttttaaatgttttaagtagtgtaaaatatacataacataaaatttaccattttaatcatttttaagtatatggtttagtggcagtagatatgtttacattattgtgcaaccatccatctccagaacttttgtctgcccaaaccgagaaactgttcccattaaacattaactcctcattccttcttccccctgcctaattcttttaccctcatttgtgcagagtagttgaccaga

SEQ ID NO: 71054 - DNA, 605 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagaggtttgtaatctacctgtctcatcaatgaacataacctgaatgtactgttcagagccattcagcagctttctttggcagccacggggtagaggaaatgaaatgtagcctttgatgttacagtcctcaagcacctcctgtctagagtcatttgctctgctggtggccatcagggttagttaaatttgtttcctctccctgagatgcctcccttcttggtcaagaagcccttaaaaagaaaactggtatcttttccttgatgcctgtta

SEQ ID NO: 71055 - DNA, 2805 bp, Homo sapiens
tagctaggacgagctgggttgttcaaccttgtcaacccgtcggcgcggcctctggtgcagcggcggcggctcctgttcctgccgcagctctctccctttcttacctccccaccaaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71056 - DNA, 2655 bp, Homo sapiens
  misc_feature (38)..(38): n is a, c, g, or t
cgtctgcagtatcctaggctaggtacgaggctgggtgncgagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71057 - DNA, 3533 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggcacccagtggcaagtactagctgagcatttgggagatgcttgtcttacttggctgttgcttctcctgctgctggggaaaaggaatgcatcttgtcttgttcttgcagcccggcatgccagtgcttcctccacggtaaggtttggaaaagaagactaagaataagaatcattgcggccagcctgaccttggggcagaggatttggcaaccacctggcctcttattatcctgagtataatttgaaagacatattggctgacctgatacctaaggagcaggccagaattaagactttcaggcagcaacatggcaagacggtggtgggccaaatcactgtggacatggcctgttgcagtggctcatgcctgtaatcccagcactttgggaggctgaggcgggtggctcatctgaggtcaggagttcgagaccagcctggccaacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71058 - DNA, 2852 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71059 - DNA, 2993 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatgtggcatgagaggcatgagggggattgcctcgtatgataagcatcgaggtttcttgaatcctgtagttgcagtgtgtcaatccagattgtccggaggtcgtaataggtatcgccatgtaatgccagtaagagcaggctgatcccaaggcgtaccggatgcggagaactcaacgcgcgcgtgttcgctgagggggcatatattcattgagcaatgcatgggtaagcgtgagaacataatgcgcgatctagaggaacaaggtatcgttggcgtcatcagtaagaggtgagcagataggatcggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71060 - DNA, 2005 bp, Homo sapiens
gaccctgtcaaagctacccgctagctgattctacactgtcctgggtgcccccacatgcctgcccttacctggatggtgacctcggctgagctggtgcgtggaggctctgcccaggtcctggactttgtcgaagaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 71061 - DNA, 2471 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtagaggaggatgttctggacctccccctcttggtccctactagagacctctcaacagatctgtgggcccagtcattggttttatcagtgcttagatcacattaagcaccctcggccgaatttaaacccagcctcgtaccagcta

SEQ ID NO: 71062 - DNA, 2020 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggacagcagcaccaccaggacagcagcaccaccaggacagcagcaccaccagga

SEQ ID NO: 71063 - DNA, 1281 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtggttgtcttggtaaaaacagtgcagaaggcaggttgggcaaggatgtgtccgattgagaaagttagaagattaattctgggagaaaattcaatcaggaggggttggcccagggttagggcatggagacttaaggggaaggggtcgggaaataacgtgaaggaagttggctggaaaactggttatgacccgtttag

SEQ ID NO: 71064 - DNA, 913 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcaataccgctgccttctctgtagagatttcggtagatct

SEQ ID NO: 71065 - DNA, 985 bp, Homo sapiens
  misc_feature (10)..(13): n is a, c, g, or t
  misc_feature (15)..(15): n is a, c, g, or t
  misc_feature (49)..(49): n is a, c, g, or t
cgagagaaannnnanaaaacttataggctaggtacgaggcctgggtgtngttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggaggtaggaaatttgggtggggtgatcggtgtgtgatggggattcaaaggacttgagtgtgaagggagggaaaaaatacagaatctttagaaaaattacctctgagttaatcagaaactaacttaacagattttcattggaggcttgttttttgtcagttgttggaattacaaagctaagtagagcatggtttctatcaccaggactgtttgtttggttaggctgacacacgtgcag

SEQ ID NO: 71066 - DNA, 685 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacggtaaggtttggaaaagaagactaagaataagaatcattgcggccagcctgaccttggggcagaggatttggcaaccacctggcctcttattatcctgagtatttcctggaagtgtttgttactattgttattgttatagctgctattattattatattactatttaacaaataatttactcagtggtatagtgagatgggaatatcaatacatttgcctaattcttttaaatgttttaagtagtgtaaaatatacataacataaaatttaccattttaatcatttttaagtatatggtttagtggcagtagatatgtttacattattgtgcaaccatccatctccagaacttttgtctgcccaaaccgagaaactgttcccattaaacattaactcctcattccttcttccccctgcctaattcttttaccctcatttgtgcagagtagttgaccaga

SEQ ID NO: 71067 - DNA, 600 bp, Homo sapiens
tagctaggacgagctgggttgttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcagccctccggcgccggggtctccctcccacacccgtgcgcaccctgcggccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggtagagactagagatgtggtgttccactggagttacagtcagtttggtggagggagcgggagtgaagatatgtgctcactctggagcagtggct

SEQ ID NO: 71068 - DNA, 779 bp, Homo sapiens
aagtgctgggattactttgggagccaccgtgcccggccatcaatagcattttaaaggaccaataaacagcctcctataaattaaacctcttcctgtggaagcatgctctactactaaagggaaggtccttgggctccgatttgtcctttgcattgagaacggtgtggggatcaatgtgtgtgtatgtgatttatcgagttggctttgcttttttagtttttcttaaaaaaaatccttccttcccatgttactaatttatgtttttgagaagttgagtctcaaagcgtaaacaataaacctccattcataaggcagatgttgtaagcttgatggtggttgtgaaagtgatttagttttgacctcttttcgtcctacaacttcaatatcaaactgctcaggaaagcccagggggaaggtaggggcagaggaggagacaattcggaatgaatgaatagattttttgttgtttttgcttgtttaatatagaagtcccccttgttccttgggagatcatggcctttgaatatgtacacaacctttgaattgttcctactaaattatagcaagggactttggcacccaaggaattctgactttctgggattataatagtaaattcccagccatactctggactttattttgctaaccataattgagcaaatgtaaattactgctatattaatgttttaaagcactgggatagtctaattctaacttgtagttaattatgtttgccaattatttgtttgaaataaatttgtgtctgaacagctatt

SEQ ID NO: 71069 - DNA, 217 bp, Homo sapiens
ccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtcca

SEQ ID NO: 71070 - DNA, 344 bp, Homo sapiens
gagaagatcaatcaaaggttttctgccaaagcccctacaggtccacattttcccaaattacactggctgaaaggaagatgggagatgctaagaaagaaatgatgaggccagcgtggtggaggcggggatggggggtggctttacatctaatggaagaggaggagggacagaggctggacagggtgtgggacttctctttgtggagggtcttggctcttgttcaaaggagcggctgagccctttagaggcccctgctgggagttcagcccactctctgtaactcctgccgaataatgaggctgatcctgggacccacaagtccaagccaggaatgctacaaactc

SEQ ID NO: 71071 - DNA, 14809 bp, Homo sapiens
  misc_feature (13200)..(13200): n is a, c, g, or t
cgcccgggcaggtggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcagggatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcgtggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacttggaggtggagcgctggcgggagcgggtcgcccaggtgcttgagcgctggcaggctgtgctggcccagaccgacttgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgagaccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaagagatcctggcgctgaaggcgagcttcgagaaggcggccgctggcaaggcggagctggagctggagctgggacgcatccgcagcaacgcggaggacacgctgcgcagcaaggagcaggccgagctggaggccgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccgagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctatgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaaaggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttntgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaa

SEQ ID NO: 71072 - DNA, 363 bp, Homo sapiens
aaacccttcaaaaaaaaaaaaacaagaaataaaacgtgttcaaatagcaagagataaaatcaaattgtctctgtttgcagaaaacgtgattctatatctagaaaaccacattgtcacagcccaaaaactccttaagctgataagcaagttcagcaaagtctgaggatacaaaatcaatgtgcaaaaatcacaagcattcttatacaccagcaatagacaatattcttcaattcctatacaccaataatagacaagagagccaaatcatgaatgaactcccattcacaattgttacaaagagaataaaatacctaggaatacagctaatgatgggtgtgaagaacctcttcaaggagaactaca

SEQ ID NO: 71073 - DNA, 790 bp, Homo sapiens
tttgtagtgactttcaaaactgtagaatattatcgagagacatttaaaagtcatttctaaaatatttgtaagcttttagttcatgcaattgctttaaattagagttattaaaaaaccagcataaaagccatctttgatttctcagacccttggtctccctcagttcttcaaaatacatcaaactgtggtctgtcaatcagacagtgataagaaattactcaggcaatgggtttcagtcaccagcaggcaaatggcagctgagatttttgttccctgctgccaaggaatttactaactcttttatgttttgaataaaggggaaccctcaaccctgtctaccctatggaaaatccaaattgaatgttactacagccatatttatttccctctgataacagtctaaatatgcttgtataaataatggctattattagatgctaaaatgctatcatgttgtttgtccccattgtaaactaaggggattttttaaaacccttatttcttttgttttgagtctgcttgtgaatctgattgtttttgattttcttgatttaagtgttgtccttcatttcaatgacataaacatatacagtcctcagaaaaacaagcaattttcttctttccctcactcatattaaaaatttatgccaacataaatatcaaacaaaaggatcattgttaaaggtatggcattgtgttcaaatgcagaagatcctgtatgtaattataatacaatttaatgtgcaatcaaatgacatctagatttttaggatactccaagccaatattg

SEQ ID NO: 71074 - DNA, 330 bp, Homo sapiens
ctctgtggcttgtagtggtctgttttttgtttgtttgttttgtttttttctggaaatacagtgaaagcttttgatgaaatttaggccttcatgttaagacatttctattctgttatatctttaattatatttttcttattcttttgtctatctcaggggcagcagttaactgttggatcttcataactatcatcttctctctaacctttttaatgctgtagtactttttcatgacatcttgtttaccttttctcaaaattattctcttctagtgatttggttttgctgcattgactgttgttgcatttattagttatgctgttttattta

SEQ ID NO: 71075 - DNA, 1158 bp, Homo sapiens
ttaaaaaaaaatccaaaacaatattgttagaacagtgcaacaaatatttacaagtcaatagtcttttctttgtagaatattacatttatggtttcaataaatgatttagcagttaaagctgagatgaagtgtggttctcatattcaatcttgaaaaactaaaccatctttaaaaagtagaacgtccatgtgaactcatgcctgaagccatgtttgaacgctagataaaattgccctgggacagaactgtagttcacctttatgaaatcaattttaaacttgttattgtgagccacaataaatacagttcacattgcaaactatcacacactcatacaaatgttactaaaaaaaacttaccaagttatatcctctctacatgcaatgcattctggtattttctctttcatttgctttttttaaaaagatctcacaatccactaatgagtcacaacctgtggtttgtaaagtagtgttagaatgaacccattggccacatcagaaatatctaaggattttctttccaacctaaaatcttttccttctctgttaattaagagatcttaacaaatgggaaattctgagtaagttcctgaatttttctttcatttgatcatggccttctagtgtttactaaagtggtttttcttttcactgccatccttgggtatttttgtatgctgggttgtattacgggtgaagggttgatggggttgtaggcctgagaggatcatttttattacagactctatccttgactataatatgatagcgttacatggagtttagtgactcatgagctcatgtctgactcgtaaggggtcctttgttaattcagatgacattggtcttatccgttatcaagaatccatgagtttggctgggtgcggtggttcatgcctgtaatcctagcactttgggaggccgaggcgggtggatcacaaagtcaggagttcaagaccagcctgaccaacatggtgaaaccccgtctctactaaaaatacaaaaattagccaggagtggtggcacgcacctataatcccagctactcaggaggttgaggcaggagattcgcttgaacccgggaagcagaggttgcagtgagccgagatcgcgccactgggcgccagcctgggcaacagagcgagactccgtctca

SEQ ID NO: 71076 - DNA, 1004 bp, Homo sapiens
attttgagatcttgcctgctcttaatagggagtttgtgacacttagattttcaagtgttcattttatacctttcccaaatctggttgcagtgtatttagtcaagcattgaagacctaacatatggcatgttttgcaaggcacagggaaagaaaaatgaactgagaacagtgagaccttgtggaagttcccagggtgggacgttgaaaccctgggtcctgggccttcctgaatcacagcctcggtgggaggattttatgaaaggtacagtgcagttgcatcatcttacacagttgtacaggactgggaccaaaaaaggtgccatgtaaatagtgcatgcaattgtgttcagtgttcgttcagtgaggacagccccactgagctacctgtgtactcaggtggtctcggttccctttgcgttctaatggtttgagtttcttgctgtattgagagtgattctagtgtttagagactttttcaaacatcacggtctccagatgtgaagccaactacctcatttattgtatggttgaacaaacagatttgttctgatgttggaaggaaaactagctgcttttgatttgttaaaagatggtacatgagtgtttgtgatatgtaaatactaatgtgaaagattgtataccatgtacttaatgtctgacttagtggaatttcaaaggcaactttgactaagcaaatttgataaagaattggtttaagaataagatgcaactatacttagtgactttggctcacagtttcatcatccataaaatattagaagataaaattaaattatatttgcaagagacacaagactattaaggagggctagaagttatccaacagtggagtgatttagatgacaaggagttattaatcatatttgccatttcctgtcactggaatgggtaaccttgcttggcttgaatctccagttctgggaaagaacagtgctgtgcttgagagcagtttagtagaccagactgaaataaacgctctttct

SEQ ID NO: 71077 - DNA, 981 bp, Homo sapiens
  misc_feature (101)..(102): n is a, c, g, or t
agagatggggtttcaccatgttatccagggtggtctcaaactcctgggctcaagcgactcacccactcagcctctcaaagagctaggattacaggcgtgannaatcgtgcccagcctcttcccattgcttttttgtttgtttgtttgtctttgttttttgagatcgcgccactgtactccagcctgggtgatagagcaagactctgtctcaaaaaaagaaagaaaaaaaaaaaaacaaaaaacaacatacccatctaacaaacctgcacatgtattccctgaatctaaaagttaaaattagaaagcagcagatcccggtacaagaacacatggaacaagtggagtgaatgtatgctgtttgcttaacattcagtgatattgcaatcttcccatttcctagaagagaagaaacatgcatgcaggcagtcctcactttataaaagtctttggtaactaaatttggtgttggttacccctgagtcatgcatatcaagaacatgattttatctcagttaccacagtgagaactaccctgcttctggttatacagacacgatcctgaatacagataatattgattcccttagctccctccacaaatgttctagggcagtgaactttacttacaataccatctaaaaattgttgatccttgttgatgagtgactcatacatataatcccaactgcttaggaggctgagacaggacaatcactggagtccaggagtttgaggtggagtgagctatgattgtaccactgctttccagccagggtgataaagcaagagacactatcaaaagaaaaaaaaagattgttgacccatttcctttaagcgggtcatgtcaaaatcttctaaaccaaagtcaggtgtggtgctgcaagcctgtaatctgggctattcaggaggcatgagtagagggcttgcttgagaccaggaattcgagcccagggcaacatagcaaaaacttgtctcaaaaaa

SEQ ID NO: 71078 - DNA, 940 bp, Homo sapiens
  misc_feature (101)..(102): n is a, c, g, or t
agagatggggtttcaccatgttatccagggtggtctcaaactcctgggctcaagcgactcacccactcagcctctcaaagagctaggattacaggcgtgannaatcgtgcccagcctcttcccattgcttttttgtttgtttgtttgtctttgttttttgagatcgcgccactgtactccagcctgggtgatagagcaagactctgtctcaaaaaaagaaagaaaaaaaaaaaaacaaaaaacaacatacccatctaacaaacctgcacatgtattccctgaatctaaaagttaaaattagaaagcagcagatcccggtacaagaacacatggaacaagtggagtgaatgtatgctgtttgcttaacattcagtgatattgcaatcttcccatttcctagaagagaagaaacatgcatgcaggcagtcctcactttataaaagtctttggtaactaaatttggtgttggttacccctgagtcatgcatatcaagaacatgattttatctcagttaccacagtgagaactaccctgcttctggttatacagacacgatcctgaatacagataatattgattcccttagctccctccacaaatgttctagggcagtgaactttacttacaataccatctaaaaattgttgatccttgttgatgagtgactcatacatataatcccaactgcttaggaggctgagacaggacaatcactggagtccaggagtttgaggtggagtgagctatgattgtaccactgctttccagccagggtgataaagcaagagacactatcaaaagaaaaaaaaagattgttgacccatttcctttaagcgggtcatgtcaaaatcttctaaaccaaagtcaggtgtgtagagggcttgcttgagaccaggaattcgagcccagggcaacatagcaaaaacttgtctcaaaaaa

SEQ ID NO: 71079 - DNA, 555 bp, Homo sapiens
tggtggctcacatctgtaatcccagcactttgggaggccgaggcaggtggatatcttgaagtcaggagttcgagaccaacctggccaacagggtgaaacccaatctctactaaaaatacaaaaattagctgggtgtggtggcgcaagctacttgggaggctgaggcaggagaatcgcttgaaccagggaggcggaggctgcagtgagctgagatcgcgccactgtactccagcctgggtgatagagcaagactctgtctcaaaaaaagaaagaaaaaaaaaaaaacaaaaaacaacatacccatctaacaaacctgcacatgtattccctgaatctaaaagttaaaattagaaagcagcagatcccggtacaagaacacatggaacaagtggagtgaatgtatgctgtttgcttaacattcagtgatattgcaatcttcccatttcctagaagagaagaaacatgcatgcaggcagtcctcactttataaaagtctttggtaactaaatttggtgttggttacccctgagtcatgcatatcaagaacatgatttt

SEQ ID NO: 71080 - DNA, 438 bp, Homo sapiens
ccaccacacatcatatccagcatattaaaatgcagttttactcacgttacacgtgtgttttgtgtatgaaacatttttcacaaatctttttttatacttttaaacttttgcctttaaaattatctggctaagaataactcaattaagtcataaatgacaattaatatgtcaattatgtctggcaatatggtgtctactcaggaattctggaaaggggcaaatctattttatgaattattttcaaatataatattttatgaatagcaaatttaacaatgacaaataagaaatatgacatagatatttaatctagcaaatatttattttgattttgtggggttttttctttctctcttttttttttttttttttttttttttttttgagacagggtcttattctgtcacccaggctggagtgcagtggcacaatcacagc

SEQ ID NO: 71081 - DNA, 1445 bp, Homo sapiens
  misc_feature (8)..(8): n is a, c, g, or t
  misc_feature (278)..(278): n is a, c, g, or t
taagtatntattgatcattcttgggtgtttctcgcagagggggatttggcagggtcacaggacaatagtggagggaaggtcagcaaataaacaagtgaacagaggtctctggttttcctaggcagaggaccctgtggccttccgcagtgtttgtgtccctgggtacttgagattagggagtggtgatgactcttaatgagcatgctgccttcaagcatctgtttaacaaagcacatcttgcaccacccttaatccatttaaccctgagtggacacagnacatgtttcagagagcacggggttgggggtaaggttatagattaacagcatcccaaggcagaagaatttttcttagtacagaacaaagtggagtctcctgtgtctacttctttctacacagacacagcaacaatctgatttctctatcttttccccacatttcccccttttctattcgacaaaaccgccatcgtcatcatgacccgttctcagtgagctgttgggtacacctcccagacggggcggctgccgggcggaggggctcctcacttctcagactgggcagctgccgggcggaggggctcctcacttctcagacggggcggccgggcagagacgctcctcacctcccagacggggtcgcggccgggcagaggcgctcctcacatcccagatggggcggcggggcagaggcgctccccacatctcagacgatgggcggctgggcagagacgctcctcacttcctagacgggatggcggccgggaagaggcgctcctcacttcccagactgggcagctgggcagaggggctcctcacatcccagacgatgggcggccaggcagagacgctcctcacttcccagaaggggtggcggccgggcagaggctgcaatctcggcactttgggaggccaaggcaggcggctgggaggtggaggttgtagcgagccgagatcacgccactgcactccagcctgggcaacattgagcattgagtgaacgagactccctctgcaatcccggcacctcgggaggccgaggctggcagatcactcgcggttaggagctggagaccagcccggccaacacagcgaaaccccgtctccaccaaaaaaatagaaaaaccagtcaggcgtggcggcgcgcgcctgcaatcccaggcacttggcaggctgaggcaggagaatcaggcagggaggttgcagtgagccgagatggcgggagtacagtccagcttcggcttggcatcagagggagactagggaaaggggagaggggagaggttagtattttcaaaaatcatcatatagtacgtggttacacaactctgaatatactaaaacacattgaattgtatactttaaaggagtgaactatatctcaatatataaggggtgagttatagctcaataaagctgttaacaacaaaacaaaaatgccatacc

SEQ ID NO: 71082 - DNA, 596 bp, Homo sapiens
aaaatgatacttgacaatataaagacagtgaacaattacagcactacaaggctagattaataggagaaagtgggcctgtagagcagcaagaagaaatttggtcagccataaagaagaactattatcagaatgggttatcagaaaacttgttcaggctcacttggaagagaaatataaaaaggagatgaacactcatctgcttgagagtacttttgtttcctttcttacctgaaaggagggctacgaaccaggaaacttttctatgacacttatagccttttgatttacctcagactcacaggactgagactttttatttcatgtgtactttgaagtccacagatgaaagcgttgattgtttttaaagagagaaaatgccaccattttatatcttggtgtgtggtatttctagcatgtcagctgaattattatcttgccaaaggcaagaagagcctattgttccctcagatagaattaaaataagaaaaagggtagactaatagccctactcagtttctttagtcctttggacattttcatctgattacagcttcaagaaataaaaccattatcttgaaaactggaggatcaaaaaa

SEQ ID NO: 71083 - DNA, 432 bp, Homo sapiens
ttgagatggagtcttgctctgttccccaggctacagtgcagtggcgcaatctcggcttactgcaatcttcgcctcctgggttcaagcgactccagcctcccacatagccaggattacaggcgccaccaccgcacctggtatttttagtagaattggggtttcaccatcatggccaggttggcctcgaactcctgacctcatgatccacccacctcggcctcccaaagtgctgggattacaggtgtgagccactgcacctagcctaatcttgccatttttgacaatcaattagcctttctaaggctcagtttcctcatctataaaattatgatactaccacctgactgaaagggcatttgtaaaattagaaataatgtaggtaataaacctaatgcagtggctgatataggagatgcttaataaatagtatct

SEQ ID NO: 71084 - DNA, 330 bp, Homo sapiens
aaatatggaagagacattaagagataatgaagctagaatgagaagctccaattaatagcttctaataatgagaagctattaatagctccaaagcgagataagacagagagtaggagagaaattaaaccatggagtttttcagatttgaaaaattcagaataaaacattttacaaatttcagagtaggagaaataaaacaagtccacatgtgggcacatgacaatattttttttaatttttaatttattttatttaatttatttatttttatttttattttttttttgagacagggtctcgctctgttgcccaggctggagtacagttgta

SEQ ID NO: 71085 - DNA, 418 bp, Homo sapiens
taacagggtagggcatggttacatgtttaggtcaacttcctttgtcgtggttgattggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71086 - DNA, 509 bp, Homo sapiens
cggccgcggggcccgggcaccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccggtgagtcccgggcctgcccctcgcgccgccggccggcggggtggcgaccagaggacgcccttgcggctgccgccccctcccatgacactggcggacccggcgggaggaggcagacggaggtggctgtggcgataggaactgggtcacattgatcgcaacccaggcgatggtttgcggtgaggggtaattgaagaggctgtaacgttttttgctgccaagagagaataaattatttaagggaggcattagctactgcgatttaattcgtatcgctgggtgtaatgcccctctccccattctgggtata

SEQ ID NO: 71087 - DNA, 685 bp, Homo sapiens
caagggggcaacgggggaacagcgcggagaggcggcgccggcgcccgaggcagccgcggccaccgcggccacccccgcaccgcccgccggctaactcgccgcgggtgctgggccgcgctggccgcgtttgaagtctccggcgcggctgctggttggccggcgagggtcacgtgcgcccaggcaggagtttccccgacagctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggtaacagcgcccgggccccggggcccggactgtgcgggcggcagggccctcgtgcagggcttcgggtggccgcctcgctagccgcccgggcaccggggcgagcacgggggcagcgccgctggtgtgcgagtgctgccgcttgagggggccggcgccggccgccccacaatggagccgcgatggcggcggcgaccggagcggccgcccgggtgtcagagcggctgtggcggcggcgactgcggccgcgctcgcgccctgcctcttcctgactcccttccccctcagccggagcg

SEQ ID NO: 71088 - DNA, 558 bp, Homo sapiens
cggccgcggggcccgggcaccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccgggacagcaaggaaggggggaagctggtgtcctactccacagccagtcttggggttagaggaaccctgagaaatagagtaggtggtggcagctcagaagagaagaaacaggctgaatacctggcacctggaagaagaaggaatatagtacacaggggagttggcccaggacagagaagtgggcctagtttaaaagaggcttgaggcccacatgggggcccctgacattttttttttttaccagtacatctaagctcttgtagatccaatttttagtggtggaaacattacttgaggaggactcagagaagcattgtcatttggattgaaactgaagaggctctgggcaactcaccag

SEQ ID NO: 71089 - DNA, 4294 bp, Homo sapiens
ccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgacagtggcggtagagaggagactccggctggcgaccggggactggtggagtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71090 - DNA, 4407 bp, Homo sapiens
caagggggcaacgggggaacagcgcggagaggcggcgccggcgcccgaggcagccgcggccaccgcggccacccccgcaccgcccgccggctaactcgccgcgggtgctgggccgcgctggccgcgtttgaagtctccggcgcggctgctggttggccggcgagggtcacgtgcgcccaggcaggagtttccccgacagctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71091 - DNA, 4627 bp, Homo sapiens
ccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgacagtggcggtagagaggagactccggctggcgaccggggactggtggagtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactgagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71092 - DNA, 4479 bp, Homo sapiens
caagggggcaacgggggaacagcgcggagaggcggcgccggcgcccgaggcagccgcggccaccgcggccacccccgcaccgcccgccggctaactcgccgcgggtgctgggccgcgctggccgcgtttgaagtctccggcgcggctgctggttggccggcgagggtcacgtgcgcccaggcaggagtttccccgacagctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaaggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71093 - DNA, 4091 bp, Homo sapiens
cggccgcggggcccgggcaccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71094 - DNA, 4579 bp, Homo sapiens
caagggggcaacgggggaacagcgcggagaggcggcgccggcgcccgaggcagccgcggccaccgcggccacccccgcaccgcccgccggctaactcgccgcgggtgctgggccgcgctggccgcgtttgaagtctccggcgcggctgctggttggccggcgagggtcacgtgcgcccaggcaggagtttccccgacagctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71095 - DNA, 4278 bp, Homo sapiens
gtgagaagtttccactgacattatatttagcaaattgtttccatatttactttgatacgtgtatatatagttatctagtgaatttatgctttcttctgtagttctacgtgtgataataatctcaaataaaatgaaataatcttcttattctgatagagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71096 - DNA, 4298 bp, Homo sapiens
agtaatggtactatttcatttcatcctagtgagaaaggtgtgtggattttttggtggtaaattggagtcccatgtatgtgtgatcctcccaacagagtgaatttaaatatctaaagattactgagaaaggataaagttgaataaatcatagtgaacaatgtttatgtcactttttaaagttttaacacttgtaattgagtaaatcctgaaacaaagtatattattatgtttgatggatttaaactattggtcaaattctgttccatgtgtacatagtgtttctttcttactctgtaacccttttgccagagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71097 - DNA, 4191 bp, Homo sapiens
cggccgcggggcccgggcaccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccgagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71098 - DNA, 1343 bp, Homo sapiens
ccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgacagtggcggtagagaggagactccggctggcgaccggggactggtggagtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaaccttt

SEQ ID NO: 71099 - DNA, 3875 bp, Homo sapiens
atgttatgaagatattacaagggtggtatcaatggaggtggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttaacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctgggtggggtgtgcactatgagattggagaaatgaattaagttgacttgaaattattttacttttattaatcacaggtatctcaacctgcctttgtttcaccctacttcaagtacacttccacaccaggggaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaaaaacccagt

SEQ ID NO: 71100 - DNA, 1021 bp, Homo sapiens
caagggggcaacgggggaacagcgcggagaggcggcgccggcgcccgaggcagccgcggccaccgcggccacccccgcaccgcccgccggctaactcgccgcgggtgctgggccgcgctggccgcgtttgaagtctccggcgcggctgctggttggccggcgagggtcacgtgcgcccaggcaggagtttccccgacagctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggtaagtaatctagttttcacaaacctgagattttttttccccccaaattttgtcccttgagaaggagtttgtttaattgaaaagaaaggaagttacttgggatagcttctttttgtacatttgatatggattatggaaattattgtgtggacagtaaatactgagctattaatgggtgtatgagtaaaaagtatgacattaattttaaagtatcttatttacgtaatagctgcttctaaaaaattatacatttagttggccgggcttgctgactcacacttgtaatcccagtacttttggaggccaaggcgggtggatcacctgaggtcgg

SEQ ID NO: 71101 - DNA, 1993 bp, Homo sapiens
cctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagaaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtggcagttcactcggccactatgtatcactgtggctgccatggtggatggaggctggacaggacctgtggtgatcggcagtctttctggaggactcaccagggaggggtctcagggtgggcatctcctttcaccttcctgtgcatgtcacttgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaaaaaaaa

SEQ ID NO: 71102 - DNA, 167 bp, Homo sapiens
ggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggg

SEQ ID NO: 71103 - DNA, 746 bp, Homo sapiens
atcccagcacttgagaaggccgaggtgggtcgattgcttgaggccaggagttcaagaccaacctggccaacatggcaaaatcttatctctactaaaaatgcaaaaattatctgggcgtggtgggacacacctgtaatcccagctacctgggagcctgaggcatgagaatcgcttgaacccgggaggcggaggttacagtgagccgagattgtgccattgcactccagcctgggcaataagcgcaaaaatccatctcaaaataatataataataattcactggaaattgtatatcaaaaaaggcaagagtcatcaaaatattctttttgactctttctgtaggatttaggagccctaaactccccaggagcttcactctttccaattttttttttacagaaaatctacagccaagtcattctgggaataaagtgagataaactttacagtttaaatctgaattcaggactgtgtttgaatatttcagtttaccagagaagaatggaacttagagcttaaaaacaagaagaagatatgaaaatatgacatcaagctgggctgcagctaaagcagtgcctcagagggaaattcataggcttcaatacgtatattagaagggaagaggctaggtggagtagctcacacctgtagtttcaacaccttgggaggccaaggcgggaggactgcttgagcccaggagtttgagaccagcctgggcaacatggcaagaccccatctcttatataa

SEQ ID NO: 71104 - DNA, 387 bp, Homo sapiens
atacatgggtgggaggttcattcagcacccaccagtcagaaaatctacagccaagtcattctgggaataaagtgagataaactttacagtttaaatctgaattcaggactgtgtttgaatatttcagtttaccagagaagaatggaacttagagcttaaaaacaagaagaagatatgaaaatatgacatcaagctgggctgcagctaaagcagtgcctcagagggaaattcataggcttcaatacgtatattagaagggaagaggctaggtggagtagctcacacctgtagtttcaacaccttgggaggccaaggcgggaggactgcttgagcccaggagtttgagaccagcctgggcaacatggcaagaccccatctcttatataa

SEQ ID NO: 71105 - DNA, 348 bp, Homo sapiens
gcggtggtgcgatcactgctcactgcagccttaacctcctgggcccaagcgatcttcccacctcagcctcctgagtagctgggaccataggcacaggccaacatgcctggctaattttttttacttttgtagagatggggccttgttgtgttccccgggctggtcttgaattcctgggatcaagtgatcctcctgcctcaggctcacaaagcgctgggattacaggtgtgagccactgtgcccggccgcaaatcaaaatttttgagtcctatcattggctcccccaggcccataggacaaagtcctaacccctagtcaggacactcagtgtcctctgctctctcctgg

SEQ ID NO: 71106 - DNA, 370 bp, Homo sapiens
tgatctgtagcctactttgtctgatatagccactccaacttccctttgattaacatcagcaaggtacctcttttttctagcctttgtcttttaaaaaaaaaaaaaggccaggtgcggtggctcacacctgtaatcccagcgctttgggaggccaaggcggatggatcacgaggtcaggagttcgagaccagcctgaccaacatggtgaaaccctgtctctactaaaaatacaaaaattagccaggcatggtggcgggtgcctgtaatcccagctacttgggaggctgaggcagagaattgcttgaacttgggaggcagaagttgcagtgagccaagattgcgccactgtactccagtgtgggcgacagag

SEQ ID NO: 71107 - DNA, 579 bp, Homo sapiens
gtcagttatgaccaagaaaagcccatcaaaccactgcttcagcatccaagttgaagtttagtcattttggctgctgcctttaaatctttctctagcatgaatgcagtccaaggaatataaaaactctagttgttaggaaaccatggctactttcatatccttggaacaacaggtctccacaattaagttccaaaattgcagttatttttactgacatataaaatctattaaccagtattaattctgtaattttttaacaataccgattcttgcattttgattttttaaaaattaatttaatagcttggttttatgttctcaaaatttattaatgtctattttatgatgtctatttttatattatattatttaaaatttgtttagtgtttgttttaagaactccaagagatttcttagaattctctacagattttgtgtagctgcctatttgtagattttaaatttggctgttactaagcccattaaacattattagatactctgtcctattgggattattattaatattaccttaattgtgagttcttaggtgtaaagaattggcaatactacttgcag

SEQ ID NO: 71108 - DNA, 305 bp, Homo sapiens
tgcttgtttcttttaaaaggattttttaaattgagattattagattggcgtttgtgagcctccacacaaatatagcatgcaattttcaaattaaataattttctctatgttttgcaagttttaattctgaaaagtctgtgtgcacataccattctgataaaatgagggataatattttaataatttgggcagtaaaaattgttcatatctataaaagagaaatagagtagatagttatgagtaattaatatgaattatagcacaagtataagggatacatacatcctaatcatactttgagtgga

SEQ ID NO: 71109 - DNA, 346 bp, Homo sapiens
tgctcttcccctcagccaacccctaaggaagaagctgctcccataggcttttctccttgccccagcccacagtggctgacagctgtcaccctgggcttccattatgacttttatgaaacctagcacttgccctcatgggcccttctccctatgaacaaaaactaatccttattaaaatttttgtttaagtgtttatatcatgccgggccgggtgtggtggtacgcatctgtagtcccagctactcaggaggttcagcccagaagttcaagtccagcctgggtaacatgacaagacctccatctcaaaacaattaaataaataaatgttgtattaaaaagcaaaata

SEQ ID NO: 71110 - DNA, 521 bp, Homo sapiens
attataaactaaaaaatattgacaaatatcagcaattacatcgaaagaagaaggtggttgtcaaaaataaaaaccattgttatgttttataaatgttattgaagtccacaggaaatacattaatttggtgggtgtaaaattggaagaattttgaaaaatgtatgcagtggtgtaaccacaaacacaatcaggatatttccatccctccagagttgccttatgttcctcctcccaatctgtttcctgtcaactaattatctgctgtctgtcactgtaatattgcctgttctaggaaattagatgagtggaattttctattatgtggtcttttgagtctgacttctttcaataattatactgactttgagatttatccatattgttgcatgtatcagtaattcattcattttcattgctaagtggtattgtatgaatacagtttatttatccgttcatcagttgatggacgtttgggttcattccaatttttaactattataaataaagttgctataaacaat

SEQ ID NO: 71111 - DNA, 2683 bp, Homo sapiens
  misc_feature (680)..(680): n is a, c, g, or t
caaggagatttctaatggagagatgtcatagtcatggtcagcagcccaagtatgcagactcctgtccaatagatgttacaagggcaacaggaaaagcaaaatcatcctttgggagaaggaaatcaagataattttcaaatgcatgtcttaaaacccagaaataccattcagaagttccgagtatacatatatgagtttgtaagatatagttatttccgttttacataggaaatatttgagatagaattaggagttccctctgaggagtcagtttaaatgatacttacaatcatgcaattaataatatcctgatgattagataccaggtttgggttcctattacaatagaagtacatcccaccaaaactgcacttgtctgaagtcggtgcatagaaaacagcttttaaggaattcactaattaattccctctgctgaaggctaattgttgaaaagatactcctttatcagttgtggtgagactctgtcccttcctggctagttctacttgtaactgacctgagctctttcacagagtgagtcaacatgaagtgagggaaatgaaaaggggcactggaataagagtctcctgactaaaatactgtttctgtaacccactggctaaatgaccctattcactgataaaatcattccagggcaggggctagcttgagcctcaggngtgcccattctaggattcagatgctttttggtatatagttgacttatggagaggccctacaaaccgtctggaagacaatgtgtcctaagagaagtgagagagagtctggaataaaagcttggtcaaataaccttgctccagtgatgagtaaggaataataacacagagggcagtatctcaaagaggggctttcccaaaatcactgcaaaaccttggagtcacagggcagtgactccatgtagccaagattgtagcccagaaatgaaatcaatgaattctcagttcagcggaacagttttggtgtgccaggtgtctggagagcagaacatatcttaggcacctgtgaaccattggcaagcagagctctggtggacgtgagacccagtgaggttctggatcctggctcttctccttggatgtgttgctttaggagttattttcctgttagcctaagtcatttgtttttcttaggaaacttttcactcattagaagttaagctttctaaatgatgttcacacattcttttgcagagctatttatatttcttgaattattgctgagcttgcaaattacattgaggattttcttatataaataaaacagcatcaaattagagtttaaaaaaaaattagtttctgtttctttagttcatctgccagctggtatttagagcccatccgttggtcttggtgctgtgaagtgcaatgatatagccttccatttatggagttacttacttcttttgggctgcagtcatggagataagcttgccacgagtcagcttacaacttataaaaaataattaggcacttttacattctgtcttctaactctccacttcagagtggcccttcagagtttgattcttgaggctattctttattgatgggtgacatgcctttccctgaataatagcaatcctagctaacaattagtgcttgacatttgaagtgctttaaatcctttgaaaacccccaaagatttaagtattattattattgcctccattctatagctggagagactcagttacaggggcagggtacatcatctgtgcacagccacaccgttgacacttggcaccagaattccaagttgctcttaatcactctgtagttctgcctccaaatagtgagagaagagagccactgggtggaaagccaagtttgcaagcagagagactggactgtgagtcacaatgggagcaagtggttaggacagcaaaagcagtggctcatgagatgtgagcatatgtggttgactgattgatgaatgtgggagctctgagtacataacactattaagtggatgactccttgaaaactggacataggacatgcaaggcattattgattcgtatcaattagtgggtctgtttctataaagtgacaagcatgaattcattttctttgtcttattaattcttgctcccctccaatgacttggaaagaaattcagatgacttctaatatttatcagagatgaaactattgattcatacctttaaggatgatacgttcagaatgctaatttcaagaagaaataacagttgcaaagttgttttatctcaatgttttactagaaggaagacctacgtaagtttgtcccaagactaaggcaaatctagaggactgatgccacaggctggccaggtaccactggcatgagggactgagaaacttgggatggaatgcactgtattggaagagggttaaagaatggtaggtcaggaaggaaggggtgggatgtctatcactcatttagatggtcctcaagtcctgtttctgctatgagtctgaaagtaaagagtataatgaaagataagatcgaaaatgaataaatctaggacattgagagcacaaggtgtcaggagcttggcatggaacttagggctttacaatctgggcacagaaatgtgagagtgagggccttagcagccatggtggtacctttacaggcattaatcagcacaaaactgagcagatgagagttaaaaaaaaaa

SEQ ID NO: 71112 - DNA, 294 bp, Homo sapiens
agaaatgtgaggagtaaaaaatctgccctttaaagaatatcaattcattacttcaaatagtatcgagatacttgggcaggtagtggttttctgtgtgtatttttgtttgaaatgcttacccgtaacatctgggagcaggaatactatgcctctgaaacttttgaactctcacagaagcttgtttgctggctgggagaagctagcggttacacttattaatgaatagattgttttaagggatatagtattcttcgtttaagaaaaatttaacttgcaccttttgaccttacattg

SEQ ID NO: 71113 - DNA, 393 bp, Homo sapiens
gttctaaggaacccacctaatcataccatggataaaggctggggaaggaaaggtgagttacagttctgtgcacatcaaggacatgattccatgtattcttgctcatttggacacccttggagttaatagatacgcaattcagaaagtcacaggccacatctcagaattgtatatttaagaggacccctagcaactccctagaccagtgctactcaaatgagattttctgacttgtccatgaactgttttctactagcccataacaagctaataagcacagcaattgcgaataagcattgatacacttacgctgaaatttgccagaataacattatgtctgttgaagctaataaaaacttggggcttgtgttttgtatgcctccttttgaattc

SEQ ID NO: 71114 - DNA, 225 bp, Homo sapiens
gataaggtatactactgttcataaagccagtctattccaggggtaggtgtttgctgtccagagcttctgcgtcaccactgagttctgtaggtaacttagggatggggtatggttccctatccttgtatctaggacagacagtccctttgagggggtggcctccatgttctctgcccatccctgtatccaggggctgtacatggccgcagcctggccagtcccttg

SEQ ID NO: 71115 - DNA, 337 bp, Homo sapiens
gtagagatggggtttctccatgttgcccaggctggtcttgaactcctcggctcaagcagtccacctgcctcagcctccccaaagtgctgggattataggtgtgagccaccgtaccggcctggatctttcttaacatcaattgcaatcaagtgtcctaagtaactcagaattctgtaccaggagcagggttttgcaaatgacagaccctaatatctggaatttgctgtgttgaggtgggtgtaaggtggggtctcccttcctgactcggggtgagcaacacctctcaagtggtgcaaggtagccaaagcctctcctgttgagcccagtgagtcagacc

SEQ ID NO: 71116 - DNA, 729 bp, Homo sapiens
gaggaagagaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaa

SEQ ID NO: 71117 - DNA, 358 bp, Homo sapiens
aatgacagcagtgatagcttggatagtgggatatatacataaccgaagttctcatttatttaatattttcagctttccctcaaacatgaaaaaataaacaccaaaagcctttcactgtgtgttaataaaaaacctcattaggggatttatcttttatctccccactccttcccacttcccttttgtcttttaaattttatttttagtttttacttatgttttcttttcctttctttctttcttttttcttttgagatggagtcttgctctgtcgcacagtggcgcgatctctgctcactgcaatgtccgcctcccagattcaagcggttttcctgccccagcctcccaagtagctggg

SEQ ID NO: 71118 - DNA, 284 bp, Homo sapiens
agcaaagaaaaaaatgggacaaatacaaggcaaaaggcaagatggtagaattgaaaggaaatcacatcattaccttaaatgcaaattgtctaaacattccaattcaaaggcaatataaaaaagcaagacctaactatatgttgcttcaagaaacaatctttaaatatggatataggaaaaaacatctattggcaacaaagtcacagttgctgctaatattactgctgtgttttgttgcctgcattcaaaatagaaacactgaatttcattcagaggttagtgaa

SEQ ID NO: 71119 - DNA, 474 bp, Homo sapiens
gaagagggcaatataacagcaatgcagctctggcattaagtgctgagagaggctccctgctgacagacagcaaggaaataaagaccacagtcccactgccacaagaaactgatttctgcaaacaacatggaacagcttagatgaaatttctccccagataataacccaggtgagccaatacattaattttggccatgtaaaacctacagaagaggaaccagtgaaatttactctgatttctgtcctacagaacttaatgtgaatggctttaagccactacatttatagtattttgttacagcagtgacagaaaactagtgtaacatataaacacaaagaagggaaataatgatatctgtataaataattaaaatataaaaattgaccaagatggccaactagacacagccaggaagagcatctaccactgtgagaaaataccttcaataaaccagcacactctgtgcagatctt

SEQ ID NO: 71120 - DNA, 501 bp, Homo sapiens
  misc_feature (493)..(499): n is a, c, g, or t
  misc_feature (501)..(501): n is a, c, g, or t
gcctacaaggccctgtctgatttgctcccctttctctccctaacccaccacccctgcgtctccctgcaggcagtcaccttcttaggcccgggaaaatgccggtctcctactcttcatggcctttgtacctgacttggccaggaatgatctctgttcctctctttcactaagttagttcttcttcaccctcacttcctctaaagtaactccttatagggaagcctttcttggctggcaacacacacacacacacacacacacacatacacacacgactgaatcagatcggattgctctttgatagctcttttcataattgtaatcaagcaattaattgggtaatgcgttgttgttgttttctttctctcttgccagaatgtattcatgttgacccataagacattatcatttttataagtccccaaaagttgaatattggaaattttatttccacccaattcaacttaataaattctgtgtttaccttgctcannnnnnnan

SEQ ID NO: 71121 - DNA, 1683 bp, Homo sapiens
cttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcttcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactg

SEQ ID NO: 71122 - DNA, 2382 bp, Homo sapiens
  misc_feature (3)..(3): n is a, c, g, or t
  misc_feature (8)..(9): n is a, c, g, or t
  misc_feature (11)..(12): n is a, c, g, or t
  misc_feature (1122)..(1122): n is a, c, g, or t
ggnggaanngnnggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctgcgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttctggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaanaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactg

SEQ ID NO: 71123 - DNA, 647 bp, Homo sapiens
aaaacccaaccttccccaacagggccctccgctcctcccccataggcccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactg

SEQ ID NO: 71124 - DNA, 258 bp, Homo sapiens
ttttttttttaccctttaacagttcctacctccccaccaccacccccactaccctttccagtctctggtaaccatccttctactctctatgtccatgagctcaattcttttgatttttagattctataaataagtgagaacatgcaatgtttgtctttctgggtggcactcttaataatttagatgcctctaagatattggacacacaaatgaagcaaatgaaatggaaaatacttttaagaggcagattttcttgta

SEQ ID NO: 71125 - DNA, 3350 bp, Homo sapiens
  misc_feature (1003)..(1003): n is a, c, g, or t
  misc_feature (1025)..(1025): n is a, c, g, or t
  misc_feature (1107)..(1107): n is a, c, g, or t
  misc_feature (1170)..(1170): n is a, c, g, or t
  misc_feature (2083)..(2083): n is a, c, g, or t
  misc_feature (2695)..(2695): n is a, c, g, or t
gtgccactgctcaaggtctccatggctgagcctgggggctcttacaacaggctccatgcccaaggtggcagttgtggaaccatcagagagggcacagagctcatggtttatggtgtaggggctgggagcttggagggggttgtgtggggggctggactcaggcggccagaggcctgggaacatcatcctgggcacgccgtacctgtcacgcagtctgagtcatgctgccagggcaggtatccagctcccagcctgggagtgccaagagccaaatccacggcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggttgcctgtgctattcagccaatagtgctgctggcccagctgagctccgcctagagagctcacttccctttcctgccacggagtctccctcttctgcttttcccagcaggaagggcccagcctcacctatgtaacctgcagccccccgccaaccagttaaggctcccctcttagacttagaagtctatggccaatggcatccggctacctgccctccctgccttccccagggttcctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccagtgcgttggaagacatggggaccacagaagagggaagcccgagggagctggcattggtctnaactgtgggtggatgggtggantgcctgggttccatgagacaggccagcgtgtgtggggtagggagggccgccgcagtccccaggcactacctatgaagctccngcttctccctccatctccctcccctttcccttccagcccctcttttccaggaaccttgccacncccacacctacgccctcccctccccggccctccacagctgctgcagcgcacccatactctgcacttgcctcaccagctctggcttttctctaacccgttttctctctgctttctctccaactgccagctgatcgggtcaggcaagtccatcccgtcctgagagccccaggccccacttcgacctctaaacacatccctcctcttctcagagacctccctttccaagcctgcctgggcgggtgtcctgtgacttgacagtggctcccccagccccaaagccagcccccttcttctgtgacttagtctgttgtagtggtgagctgacacgtccaggtgtgaccgttgctgaaaacttgtgccccctctgtggtatgcccctgccctgttctataaatagctataaattctctctctcacacacacacacacacacacacacacacacacacatatatacatatatatacgtggccaactgcctcacctctagcactgggaatcagtcccgtgctgtgcttgtggaatcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggatggaaaaggccaagccatttttagggtgctgttgggagcagtgaaaaggtcacacccttttcaagggacacttttcctggaaagtccctggagcttagctggctcttaccctgtgaagccngctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaacaaaaaacaaaaaacaggagtcccatcaccaggcagccatgaccccatccccgcctgcttcctcgctcctatgctagcaataaataagtttcccagccgcgaataattataagaacctcttcctcatatgccagctgcaacctccgctaggtangatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaagggtcttgtcttgctaccctaatggtaaagggctgactggggaggggttgtagggacatggtgggggtgaagactccagacccacttctccaggcttatgctgacaggggcctgcttttatttatttttatttttatcccatgactttttttaaatcctgtaactaatttttcataactttttaaaataacttttcataaaactttttttttactttttttccacaacttttttttgccacttttccacagtatttttttatcctgtaactttttcatcccacaactttaatttctgttaacttttttagtttgtgttcttttaataaacacacttacatagttac

SEQ ID NO: 71126 - DNA, 457 bp, Homo sapiens
gaatctctcttaacagtaaaatctatgtaaattttcctgaactctagcttggacttcctggtcgatagcacactgcatgtgtaaacccttaattatgacttcatttattggctgatggcatttttattttcagtctagtatgtagtgcctcttagcataaccagtcttgaaggagattctaataacaccttgtctgaagtcatggaagaaattttggagtgttagaatggaaaggatcctggaaatcattttctaagttcaactttcttcctttggggaaacagacctagagaagttacttgaccaagagtaataagggggtccagcaggattagaatacagaaccctatcaaggaaaatataatatttaaatggccgattctatttcattgtaaacaatggcattcaaggcataaaaatatcactctcacgaatttacacatttattctttacaga

SEQ ID NO: 71127 - DNA, 288 bp, Homo sapiens
ctaactgctagttttcctaggcgaactaaatgtgaattagggattccatattcttttagtcttcttttttaacgaaggtagaaatacattcacaaattcagggcgatctgtatttgtgtgtaaattgaaaacatttcaaaccagacagagcaggttagtagtgtgtttttaagctgaacagcatggtatggaatgttgtgagcaacggtaaagacttttagaaggtgtgtcttgactttatgcagaattagggtgataggcagactccaaactttgctcattaataat

SEQ ID NO: 71128 - DNA, 813 bp, Homo sapiens
tcaacatccatttttatccttgacctgtttttgcctttcccagtttaaaacaggaaaatttcaagtattggtagataattataaagaagttacatgttactttacagggaggtcagtgagttctaactccaaaattcaacatatgcataaaactcatagcatccacattccttttcgagaaaatccttaagaaggttcaatctatacataactcctcacttttttctgcagccttggaacagattcctatttctttggttaagtaccagatataaaccttcgatttacaaggttgagtcataccaaaaagtgtttactttaactctaggtcagtttcataaatgtatggtagggcaagaagctagaactaaaatgtttatgttggtacaaagttatattgatggattcatgttaaaaagtttaaatgcatgtgtgatacaattccctgtaacaataccccagcacagaataatctgtgaaaggcactattctaagcaacttttaacatatattatttcatttcaaattcacaaatacggtggctcatgcctgtaatcccagcactttggcaggctgaggtgggcggatcacctgagttcaggagttcaagaccagcctggccaacatggtgaaaccccccgtctctactaataatacaaaaattagccaggcgtggtggcaggtgcctgtggtcccagctactcgggaggctgaggcaggcgaaccacttgaacctgggaggcagaggttgcagtgagccgagacctcaccactgcactccagcctgggcaataagagtgagactctggctca

SEQ ID NO: 71129 - DNA, 714 bp, Homo sapiens
gagctagagtaaacctataactcccaatgccttgtaagtttagccagaaacaactaaaatactcagaacttttgttgaagcccacaacagtataatagggagacctgggaaagcaaagggagcctagcagttgtatgtcacagtgagaagtgtcagggacagggcacaaattgcacccagggcagccactagaagaatcagtgaattaacatgtgtaaagtacccagaaatatccagaggtgatatgtgtcagaaagcattattttgtaaaagtgaaggaaacacagtgggaatgatggctccttttgcaatggccagtaagaaacctggggagctcaaagcttgagatcagccctgtaagccagatgagagtcatagaattagagaaggtatggcttcaccggaagtgccatattttgaaggagccattcaattcagtagcaacagaggaaggagttcttgagcgagaacatccaccttctatagaaatcctctgtgaagttatctggtccagggaaattcaactcaattacatatgaaaaactaaaaagcaataaataacaaagctttagagagacattctaaagaaaaacaataaaaaaaaaataacaataaaacccataaagctatagaccaaagtctcatagatttagatgcaaaatcctaaaatcgaaaaaaaacatctagccatatccataaactatatcatcacca

SEQ ID NO: 71130 - DNA, 4250 bp, Homo sapiens
tctggtacggccccgggagttaagggatcaccactgggagatcagatcttctagctggctctctgctgccacagctccgccgaagggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagcatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaaaaaaaaaaaaaaaaaaaaaattgacgccgcgccaacaaatttccgttttcctactcgtttcgggccaggggttattttatgagctctccgatgttgccacgtggcgtgtgaaccgagagaaagaagatggagagatcaccctccagacgtcgtcgcctggaagaggccccaaaattgccatataagaacccaacacgggactgt

SEQ ID NO: 71131 - DNA, 3984 bp, Homo sapiens
tctggtacggccccgggagttaagggatcaccactgggagatcagatcttctagctggctctctgctgccacagctccgccgaagggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagcatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgatgaggtgatctgtgcacgatgagtgatcttcgtccg

SEQ ID NO: 71132 - DNA, 3955 bp, Homo sapiens
cgtggtggaatcgtcgtggtggttaatccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagcatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaaaaaaaaaaaaaaaaaaaaaattgacgccgcgccaacaaatttccgttttcctactcgtttcgggccaggggttattttatgagctctccgatgttgccacgtggcgtgtgaaccgagagaaagaagatggagagatcaccctccagacgtcgtcgcctggaagaggccccaaaattgccatataagaacccaacacgggactgt

SEQ ID NO: 71133 - DNA, 2971 bp, Homo sapiens
  misc_feature (12)..(12): n is a, c, g, or t
  misc_feature (31)..(31): n is a, c, g, or t
  misc_feature (58)..(58): n is a, c, g, or t
  misc_feature (67)..(67): n is a, c, g, or t
  misc_feature (134)..(134): n is a, c, g, or t
  misc_feature (147)..(147): n is a, c, g, or t
tcatactgaagncacagctgaactgtgacanagcctatcaatactgagttacagctgnctgtgacanagcctatcagcctgtcatactggaagaaggtgggataagccgacttgctgagtcttccagcatccantacatatcatagntcgaattcggcacgagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagcatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaaaaaaaaaaaaaaaaaaaaaattgacgccgcgccaacaaatttccgttttcctactcgtttcgggccaggggttattttatgagctctccgatgttgccacgtggcgtgtgaaccgagagaaagaagatggagagatcaccctccagacgtcgtcgcctggaagaggccccaaaattgccatataagaacccaacacgggactgt

SEQ ID NO: 71134 - DNA, 959 bp, Homo sapiens
ccggcagttgagatagacggttctcacttgcaagatccgatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaaaaaaaaaaaaaaaaaaaaaattgacgccgcgccaacaaatttccgttttcctactcgtttcgggccaggggttattttatgagctctccgatgttgccacgtggcgtgtgaaccgagagaaagaagatggagagatcaccctccagacgtcgtcgcctggaagaggccccaaaattgccatataagaacccaacacgggactgt

SEQ ID NO: 71135 - DNA, 8154 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71136 - DNA, 8127 bp, Homo sapiens
aaggctggtaccggtctgggatttaaggatctgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71137 - DNA, 8319 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgagtgagtgctgggcgcccggggctggggctggggctggggctgagtggcgcctgagcgcggcctccccgcagcttcctgtttgtcattgagcacatgatgccgctgtgcatggtgatctcctgggtctactccgtggccatgaccatccagcacatcgtggcggagaaggagcaccggctcaaggaggtgcgcgggccgggactctccctggaggcgcgggctggcagggaggggcggcgtcctccctggggcctgccccaagcccctggcccacccgcaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71138 - DNA, 8229 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacacatgatgccgctgtgcatggtgatctcctgggtctactccgtggccatgaccatccagcacatcgtggcggagaaggagcaccggctcaaggaggtgcgcgggccgggactctccctggaggcgcgggctggcagggaggggcggcgtcctccctggggcctgccccaagcccctggcccacccgcaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71139 - DNA, 8229 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacgtgagtgcccacccgcccctcggagcacccacccctccccagcccatccagtgagtgacatccgccatggtgcagggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71140 - DNA, 6834 bp, Homo sapiens
ccggcctcgctggatacagttcagcccaagtgagcgtgacatcttcaaggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagtgtggagagagctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71141 - DNA, 6638 bp, Homo sapiens
ccccaagtcggtgggggtccgtccagaaactccatgcccctgcctcaccccctgcaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71142 - DNA, 7831 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccgggactcgcctttagggtaccgagc

SEQ ID NO: 71143 - DNA, 7756 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccgactcgcctttatagatcgtcttagagtact

SEQ ID NO: 71144 - DNA, 7897 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgccctgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctttggccccctgcccgcccacctccctgggagccgggcctgtacatagcgcacagatgtttgttttaaataaataaacaaaatgtc

SEQ ID NO: 71145 - DNA, 7955 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcacgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71146 - DNA, 6527 bp, Homo sapiens
  misc_feature (6366)..(6366): n is a, c, g, or t
  misc_feature (6463)..(6463): n is a, c, g, or t
  misc_feature (6513)..(6513): n is a, c, g, or t
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtgggtaggccanggccagggggggtggggccccagcagtggaggtggagcctgggtgggcagggccctgagctctgggggtggggcctgcatggggtggggctgtgggnacgtggcccctgggctctggaggtggggagggtctgggtggggtgggcanagggcagggtgggg

SEQ ID NO: 71147 - DNA, 6450 bp, Homo sapiens
  misc_feature (6366)..(6366): n is a, c, g, or t
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtgggtaggccanggccaggggtgtttatccttataattttttattattacttatcgtctcaagaccataatattatgagttatttatagagtaaac

SEQ ID NO: 71148 - DNA, 813 bp, Homo sapiens
tagagtctctacagatcttaaaggcgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71149 - DNA, 5782 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccggacgcgtgggcgacgcgtgggtc

SEQ ID NO: 71150 - DNA, 800 bp, Homo sapiens
  misc_feature (16)..(17): n is a, c, g, or t
  misc_feature (36)..(36): n is a, c, g, or t
  misc_feature (43)..(43): n is a, c, g, or t
ggagatctttaaaggnnagtcgggtactggacacgngtaacgngggctcatcagcttcgaggaggagcggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 71151 - DNA, 149 bp, Homo sapiens
cacgggtggctccctgggtgggcacgtggcccacgtggtggatggtcaccccaggccctaggtcagcctcccctcccctccccgacccccaggcatgtacgggctgccccggccctggtacttcccactgcagaagtcctactggctgg

SEQ ID NO: 71152 - DNA, 730 bp, Homo sapiens
aggcctggagagacgtaactgcatggtccagacttgctagagtctttgaggggcacagagcaagggtggggcagaggggaccagagccggggaacaggggaccgatgtagactcagtggcccccagactcggcagacggaggcccgggagagcccagacacagagggagctcgtggggagaccctgcgtccaggcccagcctgcaggagggccggggcgggccagcacaagtgtcctcagccccagcagggggtggcacaggatgccccataagcctgacctcccctgtgcacaggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgg

SEQ ID NO: 71153 - DNA, 2714 bp, Homo sapiens
  misc_feature (1378)..(1378): n is a, c, g, or t
  misc_feature (1380)..(1380): n is a, c, g, or t
  misc_feature (1382)..(1382): n is a, c, g, or t
gagacagggttcgcgttgtcacccaagctgaggtgcagtggcgcaaacacagctgactgcagcttcgactttccaagctcaagcaatcctccttcctcagcgcccccaacaagtagctgggaccacaggcctacaccaacacacccagctaatttttgtattttttgtagagatggggtttcaccctgttggccaggctgatctcaaactcctgagctcaagcaatccacttgccttggtctcccgaagttctgggatgagccattgtgtgcggcatgagccattgtgcacggccggtccgttgctaaatgtattctaaaatacaaattctagaaaaggtagcagtggggagatagtctaaaaattttacatttgtcaatttcttaatctgtcagcctctagcaagactctaagtttcttattaactgttatttccccagaacatcaattatgcctggtatttgataagcactcaataaatatgtgataaacagatgaatttaaaaatccctgccagatgtgacattgtattactggaatcaaaaactagtggtgctgtctcatgacagaatgcagtaaagctgcatacaaagggacctgtcaaaggaaccatcactaggtcatttttgaagtgaatacttcatgtgaaaaaccataggctgtagtgaagacaatccttggttcagtttttgacattctcagttgtaaaaggaattttgatttgtttcattataacgtaaaggcttatacaaagcaccatacggagctgagctaggataaaaatatacatacagatagtagaaggatataaaccctaaaatccattaggaaagcaagaatgtccactctcactattctattcaacactgcactggaggttctagttacagcaattaggcaagaaaaaataaaaggcatatagattgcaaaggaagaattaaaaccacctctgctcacagatgacatgctcttgtatatagaaattatttaaaatctactaaacaactattagatccaataaactaattgagcaaagtgtcagaacatatccctgtcattaagtaacatatgactgaataaaattcagtttttggattaatctcatttaacctaaaaatgagattaagaaaacaatttcgtttaaaaaaaatcaaaaagaataaaatatttaggaataagtttatcccccaaaatacaagaattatacactgaaaactacagaaaaccgtagaaagaaagaaaagaagacctcgataaatgggaaaagactcccatgttcctatatcagaagacttaaaactgctctaatattgcagtatgagctgatcgtgaggacgcagagaaaaacacagcctagaagcatagcaagaaatctgtntntntaggtttttattgccttggtaatcaacactcagggtgtctgatcaccatgtaaagtgaacagcattatagtcctgcagctcacactgtccaatgacttttctgagcaatttttacacctttggttcattacttatcaaaaaaggaaatggggttaatgtcacaggatttgttcctagtaaatttatattggttcttaataatcattacttttcagttttttatactcgattagatttacctcctgttaatatatagaagtacttacaaagaccaaggaattctagtatgcacaggttagtgatcttataaaataagacgccttactagtaaaaccatgtcagttgatacatgtaataaactatcaaagcatattaaaatattctgtactctcattccaaaaatataggacggttctattgtgttttatacacctgggggccaggcacagtggcttatgcctgtaatgcaagcactttgggaggcagaggaggtaggatggcttgagcccaggagttcgagaccaacccgggcaacatagtaagacctcatctctactaaagataaaaaaataaaataagcttagccaggcatggtagcacacgcctgtagtcccagttacttgggagacagaggcaggaggatggcttgagcctaggaggttgaggctacagtgagccctgatcctgccactacactgcaacctgggtgacagagcgataccctacctgtcttaatgaaaaacaaaaacaaaccaaaaacaacctggggagatgtcaatcaagccaaaatagaaatgcaaactaaaaacaaacaacaacaacaaaacactggtgttcacattttgtattgcttatcctgactcagaaatcaataatcaaacagaacccaaaagaagagatagaagaattaaatcctaccagctcatataaatccttccagctcatatttactatcgctattgtgtggggaaggcacagcagggcaaatggacctatcactcagaacgcttgtcaagacttcggaaattaatttctttccatgtgacatagcaaattccccaatattaataaaaggctccatcaataaaacagaaaatgttaagtgtttcagtgagtttgggtgataaatgtcagaatatgaacaacaattctgataccctaacacttcttgagaaaattatctcatacaaaaaatcccaaatttaacaacagagatctcaggaagtacttctctcacttaatgagccttggcagcatttcaaattaaacactctattgtgcgaggagctaattatgttaagattaaactcaaagaatgatagggacatttac

SEQ ID NO: 71154 - DNA, 318 bp, Homo sapiens
aaattttcgttatgactattcaggtatttttacataaatataattaatattacttaaataatgtaaagatgttgaaaatgataaatcagtagagctttcatttatttgaaactatcacaacatatgtgtggttaaaataaaacattatctggagactttataattttatttctacatttgtggttgtgcaacgtaaatattaacaataatttcaaagtaaaattttgcaatttcagaaaagatctataaagacatttgaagtcgtaaggctacattgatgttagctatgctttgtgacaaaactatgccaactatacc

SEQ ID NO: 71155 - DNA, 381 bp, Homo sapiens
aatatttttatcaacttttcaaaatgaaagataatatatcaaatcccgaagtctgttccctcacctaattgtgaaattcatttctgatatgatccattaacaaggtacaaaatggatagtcaagtattttaagaagcaggggagaaaagaaacccaggttggtattacatgttagatatgcatccaattttcagtacaactgactatgaatactagaattcatcaacttgaagtaatccaactggtacagtaaagcaaaaactgatttctccttttatgtcctcctgctcagaagaaaccttctgtccatttttggaatagtcaggttatgtgttacaaaagagtttctgggcaggagagccatgaacatgaccaatgggg

SEQ ID NO: 71156 - DNA, 1460 bp, Homo sapiens
gtaggatcctcaaacaccgaatgctgggttttttgtttgcttgttttcatctttgtgctgtagatcttgctgctcactgttcccaaataccctttcctgcacttctgtttgttacatatgataatgccattatactggaactttgcacaatgctgagttttgtagccacaaaaatattagagtgttcattgggtagataaataccattagattgatctagacttacttttttccattgtagaaattatgtatatcacatctctaatgggggtgtttttcaaagttatttgaacatttccagtggtagggagctcctgctttacaaggcaaccattatatttttcaaaaactcttaagtcttacaaagttatctcataagaacagccctaatttcttctttccaccactttgtaaacagtaatatactttaaaatgtgtaacatttagcaacttgtagctctgcatgcagtaaaattcaacattttctgaattaatttttactgtgttatgctgacttcatgtattttattttcatgggctggtttaaaaatacgagaatggaaagatgaaagaaaagattagtacatgcaaactatagaagtttaggtagcaacccagtcctgagtttcccatttcatcttcttttattttaaattctcaatgtatttccatttgcaaagttaactcttttactaaactgtcatgagacatttgtgtaattcagactccagtactgattatagtatcttttaaccaaatacatttcactaaaaattagacttgtaaaagtgttaaaaaaataaggcttggccagatggggtggttcacgcctgtaatctcagcactttggaaggctgaggcgggcagatcccctgagtttgggagtttgagaccagcctgaccaacatggagaaaccccatctctactgaaaatacaaaattacccgggtgtggtggcgcatgcctgtaatctcagctactcgggaggctgaggcaaaagaattgcttgaatctgggaggcggaggttgtggtgagccaagatcgtgccattgcactccagcctgggcaacaagagcgaaactccgtctcaaaaaattaaataaataaggcttatgtgcagttattctcaatgagctaaaaagcttcctgaggctagaaattcttgtcatttttggctgggagcagtggcttacacctgtagtttcagcattttgggaggtcgaggcgggcagatcacctgaggtcagggatttgagaccagcctggccaacatggtgaaaccccgtctctactaaaaaatacaaaaattagccgggcatggccgtgggcgcctgtaatcccagctactcgggaagctgaggcaggagaatcgcttgaacccgggaggtggcagttgcagtgagccgagatcacaccactgcactccattctggcaacacagccagactctgtctcaaaa

SEQ ID NO: 71157 - DNA, 1428 bp, Homo sapiens
gtaggatcctcaaacaccgaatgctgggttttttgtttgcttgttttcatctttgtgctgtagatcttgctgctcactgttcccaaataccctttcctgcacttctgtttgttacatatgataatgccattatactggaactttgcacaatgctgagttttgtagccacaaaaatattagagtgttcattgggtagataaataccattagattgatctagacttacttttttccattgtagaaattatgtatatcacatctctaatgggggtgtttttcaaagttatttgaacatttccagtggtagggagctcctgctttacaaggcaaccattatatttttcaaaaactcttaagtcttacaaagttatctcataagaacagccctaatttcttctttccaccactttgtaaacagtaatatactttaaaatgtgtaacatttagcaacttgtagctctgcatgcagtaaaattcaacattttctgaattaatttttactgtgttatgctgacttcatgtattttattttcatgggctggtttaaaaatacgagaatggaaagatgaaagaaaagattagtacatgcaaactatagaagtttaggtagcaacccagtcctgagtttcccatttcatcttcttttattttaaattctcaatgtatttccatttgcaaagttaactcttttactaaactgtcatgagacatttgtgtaattcagactccagtactgattatagtatcttttaaccaaatacatttcactaaaaattagacttgtaaaagttgctgggattacaggtgtgacccacagcgccatccagatttttaatgtattgtctataatgaccctttttaagcaagtcaataaagataaaactattttagtagatgcaggttttcttcactagcctacgtgtgctactaaaaatgttttggtataagttagtgtagtatcactgacttaagcaagttggtgcatgtttatatgtcttctgtttttataaaagacttgctaatttttctgttgtcttttcttagtctcttcatagtcagaaaaaaatattgggtattttattagcttagccttgaggagagttctgcagtaaaactgccggtttccaaaaaagagggagaaaataataagaattactgactcacacttttattttatttagcaagtaaaaaataacctgttgagctagaacttatttatagtaggccctagcagaccacagctacaactaggaattaccagtcatccaaaatacaatcaagaaccattaaaaacttacattaataaccttgtacgtaccacttccacatctctatgctagaagtaaaatatctggtcttatttttctgttgcatgcaaaaaaaaaataatttatcttaagccaatatctagctatctgatagtttaat

SEQ ID NO: 71158 - DNA, 680 bp, Homo sapiens
actcccgacctcaggtgatccgcccgccttggcctcccaaagtgctgggattacaggtgtgacccacagcgccatccagatttttaatgtattgtctataatgaccctttttaagcaagtcaataaagataaaactattttagtagatgcaggttttcttcactagcctacgtgtgctactaaaaatgttttggtataagttagtgtagtatcactgacttaagcaagttggtgcatgtttatatgtcttctgtttttataaaagacttgctaatttttctgttgtcttttcttagtctcttcatagtcagaaaaaaatattgggtattttattagcttagccttgaggagagttctgcagtaaaactgccggtttccaaaaaagagggagaaaataataagaattactgactcacacttttattttatttagcaagtaaaaaataacctgttgagctagaacttatttatagtaggccctagcagaccacagctacaactaggaattaccagtcatccaaaatacaatcaagaaccattaaaaacttacattaataaccttgtacgtaccacttccacatctctatgctagaagtaaaatatctggtcttatttttctgttgcatgcaaaaaaaaaataatttatcttaagccaatatctagctatctgatagtttaat

SEQ ID NO: 71159 - DNA, 3351 bp, Homo sapiens
ctgcacgtgacgcttgcggaggaaggggagagagaggcgcgcgggaggtcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgtaaaaaaaaaaaaaaaaagaaaaaaaaaaataaaaaaaacaaaaacaacaaaaataaggagaaacaagcaaacacggagaggtccatacagaggagggcccgcgggaacaaaagagggtatagacagggagcccacggggtatccgagcgagaagcctcacaa

SEQ ID NO: 71160 - DNA, 3217 bp, Homo sapiens
ctgcacgtgacgcttgcggaggaaggggagagagaggcgcgcgggaggtcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgtagtgtgcacaacaaacacacaaaaaagc

SEQ ID NO: 71161 - DNA, 3405 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71162 - DNA, 3003 bp, Homo sapiens
  misc_feature (3003)..(3003): n is a, c, g, or t
ctgcacgtgacgcttgcggaggaaggggagagagaggcgcgcgggaggtcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccacacgctcggtctcattttggttgtctaaagctaagatactatatgacttattacattaaattacatgaagctaacacccaaagtccctgaatttgaacctcagctctcctactcactgcttgtgtgatctttggcaaattacttggacgtctccaggtgtctagggttccacaggttttaaccctggggctaataaatagtagctgtccaacgtacggcgctcaacatactacataaggatcattcctgtgaaacctttacaacggtttctgggcaggttacagtcgtcggacgtgtacccaagttaagacgcgtgtgaaatactgcggcacaaatattggcgccagaaaatacgttatctatgtgcacgcgacagcctcattgagagacccatctgtgtactaacccacgggccaaattgcgatcaggcgtacccccccactgatgtcatcaaccatgcacttcaccgccgaggagaagatgtagcttgactacaacaacaaacacaccgtcgtgcggcgcaagaacacaacgatcagcggacgaggacaagatagctagacgatggttgcatctactcgctccctcgctcttgtctcccttgctctgtttgtcgttgcttgttagtaagagagactgaccgaaggagaggcagcn

SEQ ID NO: 71163 - DNA, 2300 bp, Homo sapiens
ctgcacgtgacgcttgcggaggaaggggagagagaggcgcgcgggaggtcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttccccgctctaaagactttggggttctcgcaccaagg

SEQ ID NO: 71164 - DNA, 2783 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71165 - DNA, 2713 bp, Homo sapiens
tctaggtcctgtttccacctctggcagttgctgaaggtagtggcattggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71166 - DNA, 2616 bp, Homo sapiens
agatcccaggtgaaaccaagccatagcttttagtatattttcattttaggttaggcaagaaagttagcgaacttgtcctcaaacctaggaccatttaaaaaagtgacaataaagaagactaagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71167 - DNA, 1733 bp, Homo sapiens
agagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71168 - DNA, 1475 bp, Homo sapiens
agagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagttcacaaagttgccccagtggaggttgttaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71169 - DNA, 1780 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagtttttgacctcggctgcagcatggggatactctagagcagctctcccactat

SEQ ID NO: 71170 - DNA, 1219 bp, Homo sapiens
gaggatcccccttcctgcttctgcccttcctgcttctgcaaaatggctgcttcctgcttctgcccaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71171 - DNA, 1772 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcatgagcagttccacgtgtcctgcgaccgagcatagacaacttctgttcgcgatggctgcagtcatgatgtacatcatagaacaga

SEQ ID NO: 71172 - DNA, 3190 bp, Homo sapiens
ctgcacgtgacgcttgcggaggaaggggagagagaggcgcgcgggaggtcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71173 - DNA, 3477 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71174 - DNA, 3423 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71175 - DNA, 3037 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71176 - DNA, 2822 bp, Homo sapiens
tgagacggagaccttctctgtcacccaggctgaagtgcggtggcatgatctggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71177 - DNA, 2934 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaaggtatgtggccaatctcagaaaatggtccctagcctctatctgtggttagaaaggaagtaaaatgctctctgattctgggcatccatttccccttcttaagttggcaaaatcatctctacctccttcaaaggatgttgagggtgagtgagactttctttcttttttttttttttgagacggagtctcgctctgttgcccaggctggagtgcagtggcgcgatctcggctcactgccagctctgcctcccaggttcacgccattctcttgcctcagcctcccgagtagctgggactacaggtgcccaccaccacacccagctaatttttttgtatttttagtagagactgggtttcattgtgttagccaggatggtctcgctctcctgacctcatgatctgcccgcctcagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaacaaaaagaaaaagattttggggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 71178 - DNA, 805 bp, Homo sapiens
ctgcacgtgacgcttgcggaggaaggggagagagaggcgcgcgggaggtcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaccgtgagcggcgggggggtcctctagagt

SEQ ID NO: 71179 - DNA, 276 bp, Homo sapiens
taaaaaaaatatcgttttggcttcttaatgtgagcttcttatgtggtattttgaagatgtgttccagaatcattctaaagtgacacatagatttcagataaatcccttgctgtcaggaatatgtatttaaataattcaaatactaaagaaatcagcttctgctcacggtcacaagaacttttaactttcaaagggcaagaagagctaatgcagttactttgtcagtactaataaaagtcctgcagtttgccttcatttccactggaaacgtagcag

SEQ ID NO: 71180 - DNA, 1094 bp, Homo sapiens
tattctaaaaaataagactgggtctcaagactgcttccctaacagactgtttctcctgaaaatgcaggagctattctttctgttctggttatatagtttccattcatggcttcttgtcctgttgttttttgtgtcgagtacactatataaattatctccttatacatatttctcaggcaagcacagagttatactgaacttttctaaagatgctttgcatcaagaagcaaagggaaatacagaattaaaatgtttctttccattttgctttgtttttctatatcgatctagactttgtaggaaaatgcaaagcgtatatttaagaaaacctaaataagaatagattcatttactcattttcatttattcattcatgaagaatttattgaatgcctactatgtgccaggaatattgctatatttttgaaatttaaggataaaatatggcccaatctatcaagaaaggaaagtgaaagacaaatgtaagacataattacaacattctgtgggagcacaaagtaggggactcagttcttagagaagtcttttggtcttagagttcatcaagcagagaaggggaaggacatggtccaggaaaataaatcagcacacaaagagatggggtcttgagggtgcatagtacattctggacagccagttacctgggatgagttgggagggaggagaataaggacaaaagaccatctgggcaaaaatcacgaaggggtatgtgtgtcatgtaaaggtgtgccatgatagttattcatattgctattgtaatattaatatatagtaattaactacacatgacacagctttacatgaccttaagtagttatcaacattaccataatagtaatattaataactacaataagagccattattattcacttgaggcacttgttcaaaatagattttacaaaagaaaaaaaaaaaagaagcaacatgagtaaaattagatccattggctactgactccctctccaacagttttaaagctactagataagagaagcatcaagtcttaaaggaagagaatggtatgatcagatgtgtgttttccaaagactattagaaacagcatggttaag

SEQ ID NO: 71181 - DNA, 694 bp, Homo sapiens
atcacttgcttggggggaaccagctgccatgttgtgagatgctcaagcagctgtatggaggagcccatgtggaaaaaaactgagcacccctcacaaccgatattcccttaccaggagtgtggcaagcctccctggaagcagactcttcagcaccagtcaagctttcagatgctgcagccgtgggcaatgactttgctgcaatcttatgagagactaagccagaaccacccagctaagtggctcccacattcatgactcacgaaaactgtgtcttggttttgagctataaattcttgctgctatcttggacttttcctgagaatctgaatccttcagcacatcctatcacattccaccaattcttgaccttctgttatcctcaccagcccccctgggctttgttcaaagtcctgcagggaggctgcagagacaatggaatgcacaggctgtggtagctcagctgcggggactgtccaggcgcctaactggttgtgtgaggctttcagagaacgctgctcctgtgctgggcttcagagagagggcttgctgcagcacagtggggtggcctcctgctggtggcccaggccacagggatatggaaacatgtgtctagtctagagctgcgggcttgggtgaccttgaggcaagggaggcacctgggggctaaaatataaggaggcactcattctcctct

SEQ ID NO: 71182 - DNA, 973 bp, Homo sapiens
atcacttgcttggggggaaccagctgccatgttgtgagatgctcaagcagctgtatggaggagcccatgtggaaaaaaactgagcacccctcacaaccgatattcccttaccaggagtgtggcaagcctccctggaagcagactcttcagcaccagtcaagctttcagatgctgcagccgtgggcaatgactttgctgcaatcttatgagagactaagccagaaccacccagctaagtggctcccacattcatgactcacgaaaactgtgtgaggacacatggtgaatagagggcttgctggcaattggttcacaagctgaggagggcacaaaggccagatatttcatctgaagagttcacaggctattaaaaacattaacaagattttactgcctcacctaggatggaaataattgctttaaagtgaactggcattaaagtgaacacgtcaagactacctacttggaagctacaggagacagaaacagaaaacacgactcctgaatcatgttccattactttaatcgctaaacactgctccgtttaagctaaagagatataatggtacatttgacagatgccttcacatcaagatgagatagggccctgaaagtcgcatgttgaacctttcttaccttctacgaggatgtcactcaaaatcttttctcaattcctcttcattggctgattacacaatacagagtcattcctagtgcagcccaaccctctccccaggtgaaccttgctttacacaaaacacctgtgtataaataacctggtaatcattcaagttgtattctaaatgcaccacagagatctcactttttaaggaacactgaaataaatgctttagtgaagcaaaatagcccttttgtaatgtaaacaatataagcctaaataaagcttccaatttacctaagtttagatttttgcatattgggtttcattaaagcagcatatatctgtaaaaga

SEQ ID NO: 71183 - DNA, 993 bp, Homo sapiens
cgggcggatcacaaggtcaggaattctagaccagcctggccaacaatggtgaaaccctgtctctactacaaatacaaaaaagccaggcgtggtagcaggcgcctgtaatcccagctacttgggaggttgaggcaggagaatcgcttgaacccgggaggtggaggttgcagtgagccgagatcgcaccacttcactccagcctaggtgacagaggggatgacagagggtgctctgcgggcagggaaggcggggtggttgggggggagagaatgttgctctgataaccacagctgtggttattttgtggcaggtacaggtgaggttgcctcttctttccaccagatggcactggagaaaagggattttgattaacttaattttatacacaagattggtctttcagaaatctttatctaaatgaagaaactgttttacatgtagttcgcttttaagtcaccatgttgctaaatgctgtgagtctcaactttaaagagggttaatactaaagttgtcagttaaggctatagtcacatatagtcaaaatttactttgacatcattttaaatcatatgtaaaattcagtattatattgttcttagtgtgtctagcactaccagttttctaccagtattgaaacagggcacgtgtttgagcatcagaggaagtatactgtaaataaaaatttgaaaaataagcaaaaaggacagacaataattatctccattcccaccatactgaagtcatctttccacttttttttttaaagaaacaaaacataaagataaaagtagagttctctttaaccagctctcacagtcctgttccctccagaggcagccactgcagtgagtctgtgtatatgttcacctgttcatctgcttgcaatgttcatctgttccttatattttcacctagtgtctggaaggagatggtactgttttggtgctttaaaaataaatatcaagccatctgtgttctttatttttacttatg

SEQ ID NO: 71184 - DNA, 771 bp, Homo sapiens
aataaatatcaagccatctgtgttctttatttttacttatgtcttggaggcatctctgataaccacagctgtggttattttgtggcaggtacaggtgaggttgcctcttctttccaccagatggcactggagaaaagggattttgattaacttaattttatacacaagattggtctttcagaaatctttatctaaatgaagaaactgttttacatgtagttcgcttttaagtcaccatgttgctaaatgctgtgagtctcaactttaaagagggttaatactaaagttgtcagttaaggctatagtcacatatagtcaaaatttactttgacatcattttaaatcatatgtaaaattcagtattatattgttcttagtgtgtctagcactaccagttttctaccagtattgaaacagggcacgtgtttgagcatcagaggaagtatactgtaaataaaaatttgaaaaataagcaaaaaggacagacaataattatctccattcccaccatactgaagtcatctttccacttttttttttaaagaaacaaaacataaagataaaagtagagttctctttaaccagctctcacagtcctgttccctccagaggcagccactgcagtgagtctgtgtatatgttcacctgttcatctgcttgcaatgttcatctgttccttatattttcacctagtgtctggaaggagatggtactgttttggtgctttaaaaataaatatcaagccatctgtgttctttatttttacttatg

SEQ ID NO: 71185 - DNA, 784 bp, Homo sapiens
aaaatatgttggtgggagtatttacgaaaatatacacaggataggtaaaatgtggagactgataggactaaaagtatcaattgattgaaacaaaaggaaaaggtaggaatcttaagtaggtaaatgaaatagaaggtttaaaggaaaagtaactttaaaatgccgaagtatgttttgaacatatagaaaggtagctgtgaggaattgttaagagtaaggcaaagacttggccaggcgcaatggctcacgcctgtaatcccagcactttgggaggccaaagcaggcaaatcccttgaactcctgacctcaaatgatccacccaccttggcctcccgaagtgctgggattacaggcatgagccaccatgcccagccacattttagtcttttaaataaagataggatcaagtgttctttttctcattttgcctttgagaagattgaagttctctaatgactgactgcctggaatcatatacagactcggatttatgttttggaatagattttagttgtccattgtttcatgctgttatttatctttaatccaaatttaccttgaaattttcaggaccagagttcctgtagttagggaaaaaaaaattgtatgtgcaaaattagcaaaaaattattattttttagtggagaaaaggtttataactcttttttttttgtggagatggagagtctcgctttgtcgccaggctggagtgcagtggtgtgatctcggcttactgcaacctccgcctcccgggttcaagtgattctcctgcctcagcctgcca

SEQ ID NO: 71186 - DNA, 358 bp, Homo sapiens
aaacgtgacatagaggcaaggaatttaacttttttattttttctggctctaacaactcaaacctcgagaaatccaggaattttagttgtccattgtttcatgctgttatttatctttaatccaaatttaccttgaaattttcaggaccagagttcctgtagttagggaaaaaaaaattgtatgtgcaaaattagcaaaaaattattattttttagtggagaaaaggtttataactcttttttttttgtggagatggagagtctcgctttgtcgccaggctggagtgcagtggtgtgatctcggcttactgcaacctccgcctcccgggttcaagtgattctcctgcctcagcctgcca

SEQ ID NO: 71187 - DNA, 578 bp, Homo sapiens
agaaatttcaaggtaaaaatcttcaattaatctgcaaaacattttaagaatactaaccactgtgaatgtatattagcttagcattcagaatcattcaactctttagttgatatgtacagattatatgtggatactcaatgaagacaaattcaggtaatcaatgtttttttggaacctcagaaaaacaaaatactatctccaaaatattacctgttgagtatagagaccacttatttgattatccctagctagaggagaatgaaaacacgtgagcaaagacttctttttgctagctatgaatttctcagtaattatgtgaaattgaacaaatcagaaaaacataaaaatttcaaccttaaaatcataaaagttagattgtatatatctgatattttgtaagaggaaaaactgcaacacacattcagagttttgctagaacttttatatcaatcatttcacctgcctctgactttcattgtttatatgagtggttggggaaagaagaagaagaaaagaattttgagcacttgcaattttgtcactatgccaaggcacccttcctgataatccttcaccaa

SEQ ID NO: 71188 - DNA, 376 bp, Homo sapiens
gtttttgtactttaacacagtctgtccgtatgtactactgggaacagtggtgtcttgcagccagcttgtgttactcacaagagctgactgtggacatcccatctcctttagtgacttcatttcagtagctttaaattggccatggtggggctgtgtgtgccaggaaatcagcaaacactgcaaatcaggtctgtttgggggaagccagttgttaaacatgtcctagcctgccactgtttggggacttttccaagtgatgatgattctgtaaccatttctgtccatgcctctttgtgaaaacatgtgaaaggtttctctaagggagataccaagcagccacatggctgaagtagtcatagggtatgcagatttgaaa

SEQ ID NO: 71189 - DNA, 371 bp, Homo sapiens
  misc_feature (337)..(337): n is a, c, g, or t
acttagaagtgcttctgggatgggaggtcaggctgcagggtgatggacattgggcatgtgcttgggacactccttgaggcacatggagactatttgagatcacctctctgatcagaaagttgtttggtgagtaccaaaataagacaaaaatgagtaagtgtttttaagggagatttccctcaagctgtgtttggtagataactaataactctctgttctgggatattttctctctaggccactgtcattgacctctcaaatgcttgggggtgagaagggtaaagataatataaaaatatcaagaaaaggaaagtaaagggaaaatagtaaacactantgagggaaatctcccttaaaaacactgtcgacgc

SEQ ID NO: 71190 - DNA, 476 bp, Homo sapiens
gagacttgtttttgagcttaaagagttggggtctgatttggatccctttcatctactgtaaattggccttgttgtttatgtagcttcttcctctgtgctccttgttgagacactttgtatgcattaattcttactacatccctggaacctggagtaagagaagcatctttatttgacaggttgagaaatgggttgagtattcatgagataagcatttctacaacatcttcacctgtctggtttctgtttaatacctgatttttggtataattattgatctttcctgagaaaaaataaaataagtactagaagagtgtatatgctctgttgcctcatttcctgcccctggaaaaataacctctaagtatttggcctgagggaatgtaatgctattctaaggcttaggagtagaggctcatatgaaaacatttggcttagattattttctaccaaacttcaaaaagtgttgatacttt

SEQ ID NO: 71191 - DNA, 349 bp, Homo sapiens
atgagaaaatccacacaatgtagccaggcaactagccaatgtgccagcttactggctaagagaaaaaggcatcaatgaaaccaccattgcaaaattataactgagatggtgaaagagacctgaactaaccacttccttcttgattctaacctccaagctgtccttgttcattcctgggcataggccatactacctttaggaggaacttgctttacagtttgaaacaaagatagcagcgctttcccaacacaaacccccttcttgcctggtgaactagactgcctttgtaagactatcaaattagccaaaatcttcgaaatgatggcttaggagtcatgcagctggaggc

SEQ ID NO: 71192 - DNA, 347 bp, Homo sapiens
tcgtgatcctactggatacattctcctgggtcccaattttggccaccgctcattttcattgatctcattttaaggggtttgaggtatggagtccttaggatttggtgttaagtttggtgatttttcagagaggccgcaccagagctgcatcggtgatcatttgactttatgtctgaccctgtgcacaggggtctacttgtctcctaacctcagttttcctctttttccttattagaaaaacaacaataacatcaacacagtccctcttggaactaggaatggccagtagaagtggtgtgtgacttctgggaaatgtccttaaatagaggcggaatactcttctttgt

SEQ ID NO: 71193 - DNA, 239 bp, Homo sapiens
ccctcaccccaaagatttgaagcaaagtggtgcaacctgactgcaaaaggtgttctggtggcctgggcataggcatcaagccagccctgggcagggaagctgctggtaaccccaatagaaggtgtcttgcccttcctaggtgtctttctaaagacagggacttggtgcaggggctcaaacaaccctacacacagagctggagcgagaagccacagtggcccggggcctcgctcacccca

SEQ ID NO: 71194 - DNA, 316 bp, Homo sapiens
acttataaaagaaaaaaagcttaaaactcgggcttaatcattttttaaaattcaccttatcaaaagacattgtaaaaaataagcagccacaggttaggagaaaattatacatatatatgtgtataatgtatatattacacacacagacacacacgacaaaggacttgtttccagaatatataaagaactcttataactaatcaaaagacaatccaatttttaaatgggtgaaatatctgaaaagacattttaaaatgaaaccatccaaatagccaataaactcatagaaaagtgttcaacagcattagttatcagg

SEQ ID NO: 71195 - DNA, 276 bp, Homo sapiens
tctgccccacgtgttccacatcacgtatattaaagataacatggaaatacatgcccaaacagctactgggcatgtaattgatctgaattttctggaatgtcattcacaaaattcacccaaaatcttttaaaatgctcctacatttccacctaaccattctacttctaggaatttatctcacattaaatgagcagaggtacaccaaactatatacaagcatattcactgcagcacactgctattgcctttaggtttcctactattttcaataaataa

SEQ ID NO: 71196 - DNA, 493 bp, Homo sapiens
ggtacataagagatagcagtgggagatgggaagggagagccagaggccgaccaggacatcagcatggaaacattttcatgatacagcagctgctaaatgacttattggtactaaatgcttactgtacatcagggacgtgagaaaatcgaggcaaccctgtcggatgctctgtgcttcagccctgctctggtcttcttttggtctcattccttaccactagaacagatgttcctgaggccaagaatctagatccaattcagtatcccattacctcttctacaccatctgcatgtaccaggaaccctgaaaatccctaatccaatgctctgagcctatttctaaggactgaatgggcctcctcctttgtctgcaaacctcatctctgacatatgtatccttaggaccatagagccaaaaggagactgcttgtagttgagaagctggtacatgtggctcagggcatacacatgtacaagagggaactcattgtgtg

SEQ ID NO: 71197 - DNA, 262 bp, Homo sapiens
catgatcccttccgccaaggaactcatactaggtgagggcacccagaaacaaacacagccttaaatccataaaacagtcacatggccaatttgcaatcagggaccatttgtatgcatcaggattgacattttccttagcctcacagaacctgctgtggtgggtggtccaaattaataggctaagtacacttgtgaggaaaatgtttacaaagagcttgagaacaactcttttcaagccattagaagtacctattacaggctc

SEQ ID NO: 71198 - DNA, 530 bp, Homo sapiens
acatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctca

SEQ ID NO: 71199 - DNA, 514 bp, Homo sapiens
cccacaccaaaactttgagttaatggttcttttctatcaaaatattttgattttattttaaagtggctgattaaaaatttgtttatttctgttggacagcaagatttatataagtgacttgatctggtagtaatagtctaaatcttggggaatgtgccttccatgtagcataccatgtagaaacaaatgagaatagtgtgtgtgtgttttttatttgcaacttactggtaccatttgtttgctaataatgatgcatgtttatccatagggtcatctttccagtaactttaaccatttctaatctagctcagaaactagttgtgagctagtatgttcttagtggttgtggaaccatttttggggcatctgcaacaagatctcaggctcctccccagtctcttcatcagcttggcagcattagaagctattagatttacaactacagaaaagagataatagccactgcttattgaatttctaccacattccttatgcttttcttccatcatctgta

SEQ ID NO: 71200 - DNA, 1130 bp, Homo sapiens
ggagaagccgtctgtgggcccctctcccgcagtgtcgtcatcgccctttgacgtttctgcaaacggggtcgcgagcgaaccgaccccggtcttgatttttctgctctcccttagccgcatacgtttccagacctgcctttccttctcccaccctcatcactgagcggtgattaaagagtatttgaagcctagtcatagtggataaataggtgattgggatctagtagagattatatacaccccactctttcagcttgatggaatgctttgaaggctttggaaaagagctgtccgggacgttaggtggatttttcaattctggatagttgctctgtttgacatggagtggggtgagaagtgaagggaatttgtggaaattgcactgtgtcactaggagactgattagctgagtgaccttggataagacgagacactcaccaagtcttaatttcgtcatcaataaaaactaactggattttctcaaaaggcccttccgacttcgaaatgatttggtcaatgtaattgaagaattaactacagtttagcttgacactcctccatccctcccctccctttcctgcagtgccccctgtacacagtaagatactttcattatagagagtggctgttccatggcctgggaccaaagaaagcatttattgtacgggccagtgctaggcggattggaggcggtcaataaatacttgttgaattgaattgtggagaattcattgtaaccacatcagcaaagcactgttagtatatatgctgaacaaatgtggagaaatcgctgttttacataggaaaccatggtgatttgccccagaatgtgtatccaggtttgtatcttctctgaattaacatataagattcttgtttattatttcaggcagttttcaccactcttaaaatacaaacgaggaagctagctacttagtcttttgctcattctcgatttaaaagcatttaaaatacagatgaatagcatattaaatctaacattttcattctgtgggagtatcaatattctttgaatagctagctgtcttttaaggtagctttttcatattaaaacatttgattgctctttaaaaaaatgagtgtaaagggcaaagggcaatttatttaaa

SEQ ID NO: 71201 - DNA, 1096 bp, Homo sapiens
ggagaagccgtctgtgggcccctctcccgcagtgtcgtcatcgccctttgacgtttctgcaaacggggtcgcgagcgaaccgaccccggtcttgatttttctgctctcccttagtcgccatttgctttgattccggtgaggtgtctttttccccccccggttccttcgggacctcgaggtgaaatgagcggaaggatgagagatggacacattttgaggtgccgcatacgtttccagacctgcctttccttctcccaccctcatcactgagcggtgattaaagagtatttgaagcctagtcatagtggataaataggtgagaagtgaagggaatttgtggaaattgcactgtgtcactaggagactgattagctgagtgaccttggataagacgagacactcaccaagtcttaatttcgtcatcaataaaaactaactggattttctcaaaaggcccttccgacttcgaaatgatttggtcaatgtaattgaagaattaactacagtttagcttgacactcctccatccctcccctccctttcctgcagtgccccctgtacacagtaagatactttcattatagagagtggctgttccatggcctgggaccaaagaaagcatttattgtacgggccagtgctaggcggattggaggcggtcaataaatacttgttgaattgaattgtggagaattcattgtaaccacatcagcaaagcactgttagtatatatgctgaacaaatgtggagaaatcgctgttttacataggaaaccatggtgatttgccccagaatgtgtatccaggtttgtatcttctctgaattaacatataagattcttgtttattatttcaggcagttttcaccactcttaaaatacaaacgaggaagctagctacttagtcttttgctcattctcgatttaaaagcatttaaaatacagatgaatagcatattaaatctaacattttcattctgtgggagtatcaatattctttgaatagctagctgtcttttaaggtagctttttcatattaaaacatttgattgctctttaaaaaaatgagtgtaaagggcaaagggcaatttatttaaa

SEQ ID NO: 71202 - DNA, 3504 bp, Homo sapiens
  misc_feature (2)..(2): n is a, c, g, or t
  misc_feature (4)..(7): n is a, c, g, or t
  misc_feature (11)..(11): n is a, c, g, or t
  misc_feature (18)..(18): n is a, c, g, or t
  misc_feature (22)..(22): n is a, c, g, or t
gnannnngggngagaganaganagagaggagagagaagaaacgggaggaggggataaggaaattaaaccctttaagtcaatgcatattgtggtgacaccggcacaggcgccctcacggtggagtcggccagggctgtgcgttcccaaaatatgaccaggggtgcttggatgtgtcggcagtatgacgacggcttaaaaatctggttggcagcaccccgagagaacgagaaaccgttcatcgattccgagagggctcagaaatggcgactgtctctggcatctctcttgtttttcacagtcctgctctctgatcacttgtggttctgcgccgaggccaagctgacccgggcccgggacaaggagcaccagcagcagcagcggcagcagcagcagcagcagcagcagcagaggcagcggcagcagcagcagcagcagcggcggcagcaggagccctcctggcccgcgctcctggcgagcatgggggagtcctcgcccgccgcccaggcacacagactcctctccgcctcctcgtcccccaccctgcccccctccccgggagacggcggcggcggcggcggcaagggcaaccgaggcaaagacgaccggggcaaggctctttttctaggaaactctgccaagcccgtgtggcgcctggagacttgttacccccagggcgcgtcctcgggccagtgcttcacggtggagaatgcggacgcggtgtgcgccaggaactggagtcggggggcggccgggggggacgggcaggaggtgaggagcaagcatcccactccgctctggaacttgtcggatttttacctttcgttttgtaattcctacacactttgggagttgttctcggggttgtccagtcccaacactttgaactgcagtctggatgtggtgctcaaggaaggcggcgagatgaccacttgcaggcagtgcgtcgaggcttaccaggactatgaccaccatgctcaggagaaatacgaagagtttgaaagcgtgctccacaaatatttacagtcggaggagtactcggtgaaatcctgtcctgaagactgtaagattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaataaaaaaaatccctaagtctcccttctacccacagaaccaacaacacccttcccggcctttcctttccctcgccctcttctcgtcccctaagcaaacaacatccgcttgcttctgtctgtgtaaccacagtgaatgggtgtgcacgcttgatgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactattcatgaactgtattgctccagttcccatccccaagtgggcccagccctttcttgctgggtccagttgggacagggaggcagctattctaggaattcagggtgcgggggagttgagggaagttttttctttttggacaatgaaggtgggctttcattgtgatttttgttctgttgcagtaatataggagcacattttggccattgtaattacagggaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaataaaattgctagaattgtttagcagtacatgcacaatattttactagattctttgttttaatagtgttttgttgagactgaaaatcttaaaatggtctgcgcaaatacaaaaaaaaagaaaacaccaaaaaatgca

SEQ ID NO: 71203 - DNA, 3446 bp, Homo sapiens
  misc_feature (2)..(2): n is a, c, g, or t
  misc_feature (4)..(7): n is a, c, g, or t
  misc_feature (11)..(11): n is a, c, g, or t
  misc_feature (18)..(18): n is a, c, g, or t
  misc_feature (22)..(22): n is a, c, g, or t
gnannnngggngagaganaganagagaggagagagaagaaacgggaggaggggataaggaaattaaaccctttaagtcaatgcatattgtggtgacaccggcacaggcgccctcacggtggagtcggccagggctgtgcgttcccaaaatatgaccaggggtgcttggatgtgtcggcagtatgacgacggcttaaaaatctggttggcagcaccccgagagaacgagaaaccgttcatcgattccgagagggctcagaaatggcgactgtctctggcatctctcttgtttttcacagtcctgctctctgatcacttgtggttctgcgccgaggccaagctgacccgggcccgggacaaggagcaccagcagcagcagcggcagcagcagcagcagcagcagcagcagaggcagcggcagcagcagcagcagcagcggcggcagcaggagccctcctggcccgcgctcctggcgagcatgggggagtcctcgcccgccgcccaggcacacagactcctctccgcctcctcgtcccccaccctgcccccctccccgggagacggcggcggcggcggcggcaagggcaaccgaggcaaagacgaccggggcaaggctctttttctaggaaactctgccaagcccgtgtggcgcctggagacttgttacccccagggcgcgtcctcgggccagtgcttcacggtggagaatgcggacgcggtgtgcgccaggaactggagtcggggggcggccgggggggacgggcaggaggtgaggagcaagcatcccactccgctctggaacttgtcggatttttacctttcgttttgtaattcctacacactttgggagttgttctcggggttgtccagtcccaacactttgaactgcagtctggatgtggtgctcaaggaaggcggcgagatgaccacttgcaggcagtgcgtcgaggcttaccaggactatgaccaccatgctcaggagaaatacgaagagtttgaaagcgtgctccacaaatatttacagtcggaggagtactcggtgaaatcctgtcctgaagactgtaagattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaatttcctttccctcgccctcttctcgtcccctaagcaaacaacatccgcttgcttctgtctgtgtaaccacagtgaatgggtgtgcacgcttgatgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactattcatgaactgtattgctccagttcccatccccaagtgggcccagccctttcttgctgggtccagttgggacagggaggcagctattctaggaattcagggtgcgggggagttgagggaagttttttctttttggacaatgaaggtgggctttcattgtgatttttgttctgttgcagtaatataggagcacattttggccattgtaattacagggaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaataaaattgctagaattgtttagcagtacatgcacaatattttactagattctttgttttaatagtgttttgttgagactgaaaatcttaaaatggtctgcgcaaatacaaaaaaaaagaaaacaccaaaaaatgca

SEQ ID NO: 71204 - DNA, 2334 bp, Homo sapiens
actataatcctcacaatgagtaaacacaaaaaagaaaaaaaccggccccctccgcttttctagaatcggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaataaaaaaaatccctaagtctcccttctacccacagaaccaacaacacccttcccggcctttcctttccctcgccctcttctcgtcccctaagcaaacaacatccgcttgcttctgtctgtgtaaccacagtgaatgggtgtgcacgcttgatgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactattcatgaactgtattgctccagttcccatccccaagtgggcccagccctttcttgctgggtccagttgggacagggaggcagctattctaggaattcagggtgcgggggagttgagggaagttttttctttttggacaatgaaggtgggctttcattgtgatttttgttctgttgcagtaatataggagcacattttggccattgtaattacagggaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaataaaattgctagaattgtttagcagtacatgcacaatattttactagattctttgttttaatagtgttttgttgagactgaaaatcttaaaatggtctgcgcaaatacaaaaaaaaagaaaacaccaaaaaatgca

SEQ ID NO: 71205 - DNA, 1689 bp, Homo sapiens
atttttttagcgtgtgtgttttgcttaaactataataggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaataaaaaaaatccctaagtctcccttctacccacagaaccaacaacacccttcccggcctttcctttccctcgccctcttctcgtcccctaagcaaacaacatccgcttgcttctgtctgtgtaaccacagtgaatgggtgtgcacgcttgatgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactattcatgaactgtattgctccagttcccatccccaagtgggcccagccctttcttgctgggtccagttgggacagggaggcagctattctaggaattcagggtgcgggggagttgagggaagttttttctttttggacaatgaaggtgggctttcattgtgatttttgttctgttgcagtaatataggagcacattttggccattgtaattacagggaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaataaaattgctagaattgtttagcagtacatgcacaatattttactagattctttgttttaatagtgttttgttgagactgaaaatcttaaaatggtctgcgcaaatacaaaaaaaaagaaaacaccaaaaaatgca

SEQ ID NO: 71206 - DNA, 3370 bp, Homo sapiens
  misc_feature (2)..(2): n is a, c, g, or t
  misc_feature (4)..(7): n is a, c, g, or t
  misc_feature (11)..(11): n is a, c, g, or t
  misc_feature (18)..(18): n is a, c, g, or t
  misc_feature (22)..(22): n is a, c, g, or t
gnannnngggngagaganaganagagaggagagagaagaaacgggaggaggggataaggaaattaaaccctttaagtcaatgcatattgtggtgacaccggcacaggcgccctcacggtggagtcggccagggctgtgcgttcccaaaatatgaccaggggtgcttggatgtgtcggcagtatgacgacggcttaaaaatctggttggcagcaccccgagagaacgagaaaccgttcatcgattccgagagggctcagaaatggcgactgtctctggcatctctcttgtttttcacagtcctgctctctgatcacttgtggttctgcgccgaggccaagctgacccgggcccgggacaaggagcaccagcagcagcagcggcagcagcagcagcagcagcagcagcagaggcagcggcagcagcagcagcagcagcggcggcagcaggagccctcctggcccgcgctcctggcgagcatgggggagtcctcgcccgccgcccaggcacacagactcctctccgcctcctcgtcccccaccctgcccccctccccgggagacggcggcggcggcggcggcaagggcaaccgaggcaaagacgaccggggcaaggctctttttctaggaaactctgccaagcccgtgtggcgcctggagacttgttacccccagggcgcgtcctcgggccagtgcttcacggtggagaatgcggacgcggtgtgcgccaggaactggagtcggggggcggccgggggggacgggcaggaggtgaggagcaagcatcccactccgctctggaacttgtcggatttttacctttcgttttgtaattcctacacactttgggagttgttctcggggttgtccagtcccaacactttgaactgcagtctggatgtggtgctcaaggaaggcggcgagatgaccacttgcaggcagtgcgtcgaggcttaccaggactatgaccaccatgctcaggagaaatacgaagagtttgaaagcgtgctccacaaatatttacagtcggaggagtactcggtgaaatcctgtcctgaagactgtaagattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagggctttatgaaacctttctaaccaatgatgaaccagaatgctgtgacgtcaggagagaagaaaaatcaaataacccatccaaagggaccgtagagaaaagtggctcctgtcacaggacatcgctcacagtgtcatcagcaacaagactgtgcaacagcagactcaagctgtgtgttcttgtactgattctcttacacacagtgctcacagcctcggcagcacagaacacagccggactgagctttggaggcatcaacacgctggaagaaaactcaaccaatgaggagtaacggaaggacgagtgtcaccacagcagcagctggcccgccgtgaaaaatggcaactgctgtctcatgtaacagaaactgggtgcttttaccctcgaattacttattgcaaggcctttagggtaaaatttaaacagatgggcctgaatccaaacaaggacacaaccacagctttttattgactaaaaggctggaaagtgactttaaatttctcacaccattttatacactgtgttttaatgtttggaggttttatttgctttcgttttggtttgggtttatttgtttgtttattttttgcacttgttaatacaggatttattttgggggatggtttctcagaggtaaactaagtcttttcactgtctctatctctctatatatttctagtcattgtgtgtgttcatcagatagttctgtctttatgtcctgtcagcttctattagaggaatgattgctatgacctcatggtatagcaaaaaacaacaacaaaaaaagaataaaaaataaaaaagacaaaaaaaagaaaacaacaaaaaaataaaaataaaaaaaatccctaagtctcccttctacccacagaaccaacaacacccttcccggcctttcctttccctcgccctcttctcgtcccctaagcaaacaacatccgcttgcttctgtctgtgtaaccacagtgaatgggtgtgcacgcttgatgggcctctgagcccctgttgcacaaaccagaaacagagcggagccaagggggcctgacaagagttcctttttagctgaacaaacaagtgctctccataataggtggaatcagacagttaacacatttttatgttgaaaacaaaataaaaggaaaaaattaaaaaaaactattcatgaactgtattgctccagttcccatccccaagtgggcccagccctttcttgctgggtccagttgggacagggaggcagctattctaggaattcagggtgcgggggagttgagggaagttttttctttttggacaatgaaggtgggctttcattgtgatttttgttctgttgcagtaatataggagcacattttggccattgtaattacagggaacaaagggattgcggacacatatctggacttcttttcctcccttattgttgtggaagagacactagaaatgctcaaacacctgcaatatacagaatatacacaattttattccagtatttccctaacatatggtttaaaattattccaggtatacagtgtatgcaattctgcattatcacagaggaacaacttcttttttaaaaaataaataggtcagccatttttattaacgtgcaaaaactttatcactctaacatgctctaggtagttgaggaaaagaggtctgatcactgtttgtattttattttctttgtgggaacatttcacctgctgagtgtacatgaatttgctttctataaaaggcttttatgagtttacagtagaatcagtggaaggaagagttaataagggctgtttttaaaaaaacaaacaaacaaacaaaacaaataattaaaaaaaaattttacattccttcctattctctaactacacttgggaagtgcacttcagataagtttgcagtgtgactgagagatgaaggaaatccatagaaaaggtcctcttagtgaacaaaatttagttattaactttatagctatgaaatttccccgggcatttgtttttgttcaaacagactttaacctctgcatcatacttaaccctgcgacatgcgtacagtatgcatattttgttttgaaaaaaaatgtttcgttccagtctgttaagaatattcaaaaataataaaggtattgcttaata

SEQ ID NO: 71207 - DNA, 376 bp, Homo sapiens
taaaaaagaaagaaaaaaagaatgtatgtgagcgatttgccacagagaaagaacagtgtcaccctgtattgagataaaagtgccacatctctacttaatttaaccttcttgttgacacaataccatgattgggatctcggttacctctcacattgatccaaaactgcacactatcatcctctactttacaggtgaggaaactgaggcacagagatacttaataattcacctagggtcacaaagagcagggcagaactgggattcaagcaagggagtgtgatcccagagcccacatgcttcacctctacaccacactgtctccagacaatcagtacactgacgggagaggggcaagaaacaaaaaggctttgtgtct

SEQ ID NO: 71208 - DNA, 443 bp, Homo sapiens
gtgccctggagggaaaaaaaaatcaccctagttgagaaccactgatttagttttaatttagggtatgtatttaaaaggcagaaaaataagtatagaatcaaacttaattaagcaaatgccctctaaaaaacactgaattttaaaagaggtaatagtaaaatttgaatttgcagaaatgtaggacttgcttttaaagctcatatcttaagtacatactaaccacatatggcttctcaactgtacttgagatttcttcaatcaggaaataagatcatccaccttttttttcctgaaggtatcacctatgattctaagtaatattggatgactggatgttaatgtactatgccttcataatttctaaagaaatgtatgaataagatattaacctgacataaatagtactttcttgctgtggctctagtaaagtcttaacatctgca

SEQ ID NO: 71209 - DNA, 356 bp, Homo sapiens
taagaagttccaaaatctttaagtagcttccattgaaaataggatgagttttgaggaatgaggtgaaagtaaattttctttttatacatatctgtattgcttaaacattttacaaaattatgtacatttatttcttgaatgattaaaaaaaatatatgaggcctgatgtggtggctcatgcctataattccagcactttgggaggctgaggtgggtggctcacttgaggtcaagggttcaagaccagcctggccaacatggtgaaaccccatctctactaaaaatacaaaaattagtcgggcgtggtagtgcatgcctgtagtcccagctacttgggaggctgaatcaggagaatt

SEQ ID NO: 71210 - DNA, 531 bp, Homo sapiens
acacattgtgacctcagggtcacattgtgacacattgtgacctcagggtcacattgtgaattagctgcagactcaaggctagaacttaggttttctggatcccagttcagtgtcctttctagtacataaagagatcctcattgtctccttcttattccatttactgaggacttatatagcagaaagccaagcaaagagaaatagatattgttcctatcctcaaggaatcagagtctagtgagtggaaagtgaaccattaatccagcagtgccctgcaaagacggctaaagcagagcttctcttcgcctcagataaagaagccaggagctacaattccttcccacctgctccctagataccccgttccaagacaggagcacccaagtctctgacaccctcctgcttcacccatccgcctgacttggctgaacgctggtgtcctggaactcattctctttctctgatcttcctgtccactgccagagagtggtgccacaattccaaaaatgaaaggaaagtaaaagatataga

SEQ ID NO: 71211 - DNA, 405 bp, Homo sapiens
atgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctc

SEQ ID NO: 71212 - DNA, 609 bp, Homo sapiens
aacctagatcccctgcatgcacagttcacaatagggtttgtgctcctatgagaatctaatgctgtgctgatccgacaggaggtggagctcaggtggtaatgctcgctcacctaccactcacctcctgctgtgtggcctggttcctaacaggctcgggggctggggacccctgctgtaaataacctttcgaagatctgaaaattaactttagtatttttttgtatttactcgatattttaaacaaacaaaaatctagagaatgacataacaaatgtattttctgcgtatccactactctttactcagatcctaacattctcagttttgaaaagatgtaggctggtcacagtggctcatgcctgtaatgtcaacactttaggaggccaaggaggacagatcacgtgaatccaggagttagagaccagcctgagctataaggcaaaaccctgtctctacaaaaattagccaggtgtggtggcctgcacctgtagttctagctactcgggagcctgaggtgggagggtcaattgaccagaggctatagtgagctgtgatcctgccactacactccagtctaggtggcaaagcaagaccctgactcaaaaaaaa

SEQ ID NO: 71213 - DNA, 489 bp, Homo sapiens
tactatattgtgtacttaaaaaattgctgagggggtagatcttttgttaagtgttcttatacacatacacgttaataataatagtaatattaaagagagtaagacgaaacttttggagatgatggataggcttatggcataagtcgtggtaatggtttaaagagtatatatttatgtccaacgtcatcaagttgtatacatatatatagctttttatatgtcaatcatacctcaataatgtggttaaaatgtgaaagtgagatctcagttctgctttagaattgtctgaaacttcataatctgaaaaattaaactttattgttttctagtgtttgcataccaatcatatatatataccaccagctgatttgcaagtttaaatgtgattatacttattctgatgtattatgttattatatttggtgatcaagtatatgaaattttaatttaggtcttattcactacgaactatgtcaagtgaaagaactg

SEQ ID NO: 71214 - DNA, 942 bp, Homo sapiens
cagagggtgaaaggtagctgtcttttgactaaggaagaagaaatgctatgaaaatcaatcacttctgcctcaatggaagataattttttaaacagaattctttacttttttttaatacaggatctcactttgttggccaggctggaggacagtggtgcaatctcagctcactgcagctttgacctcctgaactcaagccatcctcccaccgcaacttcccgagtagctacaagcacacgccaccacacccagctaatttgttgttgttgtttgtagagatggcctttcaccctgttgcccaggtcgttctcgaactgtgagctcagtcgatccccccactttagcctcccaaagtgctggaattaccggcatgagccacacgcccagccaaacaaaatgcttctacttgcctctcacccctttacgtaggacagccttgacctgaggtgaactctagagatttcgaacccttgctcattcagcaaaatgccagcaattccaggaataagatatcaggaatgaagctacagcgatgagcatttctatcctaaatactgtttcacttaaccaggccattctctgtcctttatggcagtctggtgaatagtgagaatgtgtcaatggaatataaagtatctaagggccaggcgcagtggctcacatgtgtaatcccaacactttgggaggcccaggcgggcaggtcgcttaaagccaggaattcaagaccagcctggccaacatggtgaaaccccatgtctactaaaaatacgaaaattagccaggcatggtggcacgcgcctatagtcctagctactcaacttgggaggctgaggcaggagaactgcttgaaccctggaggcagaggttgcagtgagccaagaccatgccactgcactccagcctgggtgatagagggagactctgtctcaataaaagaaaaaa

SEQ ID NO: 71215 - DNA, 361 bp, Homo sapiens
tatcagtgtcagatcaatagtgaatattgtaattgtgaaatgctgaagccattttttaaatcaaattaactaaaataagaatatgttttatctaccattgctaactaacattgttctggaaattttggctgacatgtcaagatataaaacaacataaaacagtttcataaagtggttggatgtaagaaaaatatgtaaaaacaatttgtatagagcaatcacatattaaaatttaatgaaaacaattccacattctacagcaatcaaaacacatgaactgcatgagctaataaatgtgagggtttcttttaagacaactactctctatacataatagttgggttaagagcctcaacttggt

SEQ ID NO: 71216 - DNA, 223 bp, Homo sapiens
cattttttaaaggtataaccatgaatttaaaatgtatttagactttaatcttgagatacatgagcatgtgcatgtggctaaaatatgtggggtcagcacatacctcctaataaagcattgtgaaaagtaaggaatcaatttatggtttattggaaagtcacttatgcacacttgtatttatacagcacaagacaccacattttaaaaattcaataactgaagc

SEQ ID NO: 71217 - DNA, 732 bp, Homo sapiens
tagtcggcacaggggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacttctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctg

SEQ ID NO: 71218 - DNA, 516 bp, Homo sapiens
gctttaacatgtctcagatactagcaaaatagagaagcctcagatggctttaggtctggaagtgtgttgctaaaaatgctaaaaatttaacaaacttttataaatccttaagagatctttttcagttttctgaagtaccgttaattgcccatgtgtttcaacttgcagacaggcaagaatttggctttgtatgtttaaaaatatgtacatcttggttcataatgatgatttatttccaaaatggtgactcatactaggattacatataaaacatcatatgtgggccttatatgtaataatgtgtaagtatagtatattaattactctgacataacatgggcagagatttgtattaatttatttctatttcatctaatcaatattttacttaagtctaaaaccttatatatatattgacatgtatcatcgtatatataaacattgtatctattgaactgagcaatctgtagtttattttaaattctgatacattaaagatgtggagaactacatgaa

SEQ ID NO: 71219 - DNA, 783 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71220 - DNA, 750 bp, Homo sapiens
gcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71221 - DNA, 763 bp, Homo sapiens
ccacgcgtcgcggacgcgtgggtcgacccacgcgtcgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71222 - DNA, 756 bp, Homo sapiens
aaaaaaccaactacggctaggtacgaggcctcgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71223 - DNA, 849 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaacaaaccacaccacacacacacacacaacacaccccaccaacaaaacagggcaaacaacac

SEQ ID NO: 71224 - DNA, 870 bp, Homo sapiens
gcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71225 - DNA, 772 bp, Homo sapiens
ccacgcgtcgcggacgcgtgggtcgacccacgcgtcgcccacgcgtcgcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaacaaacaaaaagggggacggtataaaatccctcaggg

SEQ ID NO: 71226 - DNA, 869 bp, Homo sapiens
gcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtatcacccttggccagaccaaataattagcgcgtcgtgcgtccg

SEQ ID NO: 71227 - DNA, 788 bp, Homo sapiens
gggataccccttgcggtctcatagttggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaaaggaaaggggagaagaaaaggaggaggaggaagagagagagaggaggagaggagagaaaaaaaagaggggggagaaaataagaagggggggaaaaaaggggagaagaggggggggggggagaaggggggagaggaagag

SEQ ID NO: 71228 - DNA, 523 bp, Homo sapiens
taattatactttaagttttagggtacatgtgcacattgtgcaggttagttacatatgtatacacgtgccatgctagtgcgctgcacccaccaactcatcatctagtattaggtatatctcccaatgctatccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71229 - DNA, 659 bp, Homo sapiens
gcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagagatctccttcgctgactacaaactccgaactcggcggtaccgagctcgattta

SEQ ID NO: 71230 - DNA, 345 bp, Homo sapiens
gtcgacccacaatgaaggtcttgcctccctggttctgggacagcagggtctcaaaaggattcagttgcccgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71231 - DNA, 247 bp, Homo sapiens
agcggccgcctactactactactactgctcgaattcaagcttctaacgatgtacggggaccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71232 - DNA, 452 bp, Homo sapiens
gcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgagggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttccctgttccctccctgcactcctgacccctccccgggttgctgcgaggcggag

SEQ ID NO: 71233 - DNA, 773 bp, Homo sapiens
caccccccccaaataggctaggtagaggcccgtgttaatcgcacgaggcgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71234 - DNA, 748 bp, Homo sapiens
ccccgggctgcaggaattcggcacgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71235 - DNA, 891 bp, Homo sapiens
  misc_feature (199)..(199): n is a, c, g, or t
  misc_feature (202)..(202): n is a, c, g, or t
  misc_feature (204)..(204): n is a, c, g, or t
  misc_feature (211)..(211): n is a, c, g, or t
  misc_feature (214)..(215): n is a, c, g, or t
ggatttgggattttggtggttggaaacaagtcttcaagggtgtctgtcttctcatctttctttgccaagctcatggagtcaatcaaagcatcaacagcattcaactgtgcctcggtgggagcatatttcttactgtttttcaaggatgaaaacatgtattgccgcaagtcttccatgaaaggcagctgcactacaccgnggncnatttccnagnncgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71236 - DNA, 986 bp, Homo sapiens
gcggcccgcgtccccggggatggggctcagagctcccagcatggggccaacccgcagcatcaggcccgggctcccggcaggctcctcgcccacctcgagacccgggacgggggcctaggggacccaggacgtccccagtgccgttagcggctttcagggggcccggagcgcctcggggagggatgggaccccgggggcggggagggggggcaggctgcgctcaccgcgccttggcatcctcccccgggctccagcaaacttttctttgttcgctgcagtgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71237 - DNA, 731 bp, Homo sapiens
ccacgcgtcgcggacgcgtgggtcgacccacgcgtcgcccacgcgtcgcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71238 - DNA, 715 bp, Homo sapiens
agtacgaggctggtgtgaatcggccgaggattcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71239 - DNA, 856 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
  misc_feature (821)..(822): n is a, c, g, or t
  misc_feature (825)..(825): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaacaaaacaaacacaaacacaaaaacaacagacaannaanacaaaaacggcagctatcaaaagcaaacaca

SEQ ID NO: 71240 - DNA, 922 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaacaaaaaaaaaaaaaaatccggggccttttttcggggcggcccaagcggtttgaatgggcgggccatagtgttccggcccctttttgtccaggggaattgcggcccataagggggggtaatggaaaccggacgg

SEQ ID NO: 71241 - DNA, 1002 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaacaaaaaaggggggggtctaaagtacctggaagggcagtaaccgtcccgttttgtcaggggccaagggagggatttaagaaggcggggcggtaacgggggggaaagtctgggttggagaccttggggtatggcacccggtagggaaatagtgagggagttttgatgtgttagacaattaaaggaggagggagcagtagagcggaaagaagagagagag

SEQ ID NO: 71242 - DNA, 805 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaaagtcgacgcggccgga

SEQ ID NO: 71243 - DNA, 643 bp, Homo sapiens
gggataccccttgcggtctcatagttggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71244 - DNA, 653 bp, Homo sapiens
gagtctagagtgctccccccatccggcaggttgtactgaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71245 - DNA, 737 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgaggttaaggctccaaagcgatcgtctagatc

SEQ ID NO: 71246 - DNA, 1148 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71247 - DNA, 883 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71248 - DNA, 636 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttcttgggcgctcgtgccacattgggcgctcgttccggaccga

SEQ ID NO: 71249 - DNA, 549 bp, Homo sapiens
caagcagtattcaagtcaggtcgagactcacctgtacagtccaatacatcctgcgtccctggccgcactcttggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71250 - DNA, 737 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71251 - DNA, 715 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttctgagtacgtgaacctccccatcaatggcaacgggaaacagtgagggttggggggactctgagcgggaggcagagtttgccttcctttctccaggaccaataaaatttctaagagagcta

SEQ ID NO: 71252 - DNA, 644 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttgcttggcgcgcgcgtcgcgggtcctctatagtctccctgcacgcacgcg

SEQ ID NO: 71253 - DNA, 481 bp, Homo sapiens
tcacctaacgcgtaacctcaccctaaccgcgtaccctaaccgcgcatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71254 - DNA, 846 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagggtgagcatctggccccatgctgttccttcctcgccaccctctgcttccagatggacacaggtatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71255 - DNA, 961 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71256 - DNA, 416 bp, Homo sapiens
tgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71257 - DNA, 464 bp, Homo sapiens
atcagtgtctcgtatgtacagtaccattggtggacaattgatttgataggtcagggaggcatcgtaagactcggtgctaaccaactattaggaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71258 - DNA, 663 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71259 - DNA, 1102 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgaggttaaggctccaaagcgatcgtctagatc

SEQ ID NO: 71260 - DNA, 598 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71261 - DNA, 511 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactataggcggaaaggatgatttgtaaggacctccccgaaacctaagccttttagaccctcttcccgacccgggggaaggcctattggggggccagttctcttggt

SEQ ID NO: 71262 - DNA, 594 bp, Homo sapiens
tgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccagggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 71263 - DNA, 501 bp, Homo sapiens
  misc_feature (30)..(32): n is a, c, g, or t
  misc_feature (35)..(36): n is a, c, g, or t
  misc_feature (41)..(41): n is a, c, g, or t
  misc_feature (43)..(43): n is a, c, g, or t
aattcgcggccgcgtcgacacggctgacgnnnagnnacgangnggggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttggttctatgggaaggaccagcaggagccacagggtgttcacatgctggacgttggcatgcagcacccacgctccagatagaactccctcatgtacactatagaggatccgcgcacggatagctacctgatgccttcttggcccttccgtcgcctcaggattcgctggagtgtaggtagacacaagggaaatctctt

SEQ ID NO: 71264 - DNA, 445 bp, Homo sapiens
cttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaactatgagcactgtgtttcctgggacggggcttaggggttctcagc

SEQ ID NO: 71265 - DNA, 569 bp, Homo sapiens
cgtagtatatactagagttgaaaatcatttctaacaaaaattacattgtgtctctggagaggtaatcagtgatttgcatgaaaacttaatagtacatacattgccttaaaaagtgctactttaatcttctatcatttaagaaattcctgtgactttatgtggatcatcaatacaagcaattgtagactatattctattatacatattctagaatcagcaatgtatttatttgtttggtgtttacgtaagtcttagtgtgttttataaataataggagggtttgtttaaagtgggcttttgaagatacagtgtgactttaaaagaatggtcttagaaaacttataaatagcctaaatatgtactgaagaacatttcataatcacaaaaaaagaaataatatatctcatgaattattaagaatttgttttttaaataaagtcctctttttgaaaaggtattaagaagaggaattagacaaaacttgtttgaatatggttgtaattgcagtttactgagttatatataaaaaagcccaattagtttaaacaaatacagtatctgggtttatg

SEQ ID NO: 71266 - DNA, 532 bp, Homo sapiens
ggtttcactgtgttagccgggctggtctcgatctcctgacctcgtgatccgcccgcctcggcctcccaaagtgctgggattacaggtgtgggccatcgcgcccggccactcccatagtttttaattgataacacactttgattttctaaataagcagtcatgacatctacacatgagtttttctctttgctaaaatgtaagcctcttaatttttatccttttcctgttgcattggttaggattgccaggaatattgtaataacagcacttgttcctttttattttgcagtgagaggttagaagcatttctattaaatgttatgtagttcacatcaaaattaagatattgcctctcctatttttttttttatgttaggcttcctcaatcgggttctactttcttatttaatgtaggaaagtctaagttactttaaaattttcaaattatttaaacctatttgtgttcctttaaatccgactgtacataatgtattaaatagttcactactggaaaaaacaaaaaacaaaaaag

SEQ ID NO: 71267 - DNA, 931 bp, Homo sapiens
ggaagtttagatgtattacatatagttggtattatagcttatatattacatatgcctataagtattggttgaataaatgaatgaatgaatgaattcagagagtccatgtgtttagaagcaggccacacagcatctcaaggtagaaaaacctctggatcaacaggatggcaaatctgtggtaaccatgcctgtgttcccactcctgcacccagggcagacatcactaatcaatcccagcattgtttccaatgagcagcactcagagtccttgctccccgctgaagatctgtatctagagaggagcatgccatggtccctggcaacacccctgatctcagcccttccctgtaacttcccacagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctggtaagtgttagggtctggggatgaggtgaggaagctaatgagccctgagcagctaccatgcaccaggtgctgtgcaaacaccatttcatttggtcctctcatttattcacttgacacatattgagcatctactgtgtaccaatccccagagatagtctttaaccctcacatgcattaactaataaaatatctatgaaatgc

SEQ ID NO: 71268 - DNA, 2080 bp, Homo sapiens
ggaagtttagatgtattacatatagttggtattatagcttatatattacatatgcctataagtattggttgaataaatgaatgaatgaatgaattcagagagtccatgtgtttagaagcaggccacacagcatctcaaggtagaaaaacctctggatcaacaggatggcaaatctgtggtaaccatgcctgtgttcccactcctgcacccagggcagacatcactaatcaatcccagcattgtttccaatgagcagcactcagagtccttgctccccgctgaagatctgtatctagagaggagcatgccatggtccctggcaacacccctgatctcagcccttccctgtaacttcccacagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccgcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatgcgt

SEQ ID NO: 71269 - DNA, 1303 bp, Homo sapiens
ggaagtttagatgtattacatatagttggtattatagcttatatattacatatgcctataagtattggttgaataaatgaatgaatgaatgaattcagagagtccatgtgtttagaagcaggccacacagcatctcaaggtagaaaaacctctggatcaacaggatggcaaatctgtggtaaccatgcctgtgttcccactcctgcacccagggcagacatcactaatcaatcccagcattgtttccaatgagcagcactcagagtccttgctccccgctgaagatctgtatctagagaggagcatgccatggtccctggcaacacccctgatctcagcccttccctgtaacttcccacagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgattgaaaaatggaggcacgcagtggttatgacttgctgagtaaagaatacgaaccagaatgatgtgacatgggaaaggaggtcatcagggagacctcactcaagaagtgaccttagaggagagaccagaagaagaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccggtatggagctgggagctg

SEQ ID NO: 71270 - DNA, 2214 bp, Homo sapiens
ggaagtttagatgtattacatatagttggtattatagcttatatattacatatgcctataagtattggttgaataaatgaatgaatgaatgaattcagagagtccatgtgtttagaagcaggccacacagcatctcaaggtagaaaaacctctggatcaacaggatggcaaatctgtggtaaccatgcctgtgttcccactcctgcacccagggcagacatcactaatcaatcccagcattgtttccaatgagcagcactcagagtccttgctccccgctgaagatctgtatctagagaggagcatgccatggtccctggcaacacccctgatctcagcccttccctgtaacttcccacagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgattgaaaaatggaggcacgcagtggttatgacttgctgagtaaagaatacgaaccagaatgatgtgacatgggaaaggaggtcatcagggagacctcactcaagaagtgaccttagaggagagaccagaagaagaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccgcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatgcgt

SEQ ID NO: 71271 - DNA, 1902 bp, Homo sapiens
ggaagtttagatgtattacatatagttggtattatagcttatatattacatatgcctataagtattggttgaataaatgaatgaatgaatgaattcagagagtccatgtgtttagaagcaggccacacagcatctcaaggtagaaaaacctctggatcaacaggatggcaaatctgtggtaaccatgcctgtgttcccactcctgcacccagggcagacatcactaatcaatcccagcattgtttccaatgagcagcactcagagtccttgctccccgctgaagatctgtatctagagaggagcatgccatggtccctggcaacacccctgatctcagcccttccctgtaacttcccacagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccgcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatgcgt

SEQ ID NO: 71272 - DNA, 260 bp, Homo sapiens
aacagttcccctgaccatcttcagcaagagctccaatttcagatagatataaagacttgcttttgagcctaacacgttgtaatgccccctttccctttggtaactgactgtgggatttagggaagatttgaatcccagtgactccactcaggaggctgaagcgggaggatcgcttgagcccaggagttcaaggttacagtgagctatgatcgattgcaccactgcgctccagcctgggtgtcagagcgagatgtggtctc

SEQ ID NO: 71273 - DNA, 369 bp, Homo sapiens
ctgggagcagcagtttatctcacagaacctcatttagttccatgaaattgagattggtttcttgatctatgagattgcaacttggtgtggtattgtggccttccatcattttaatgaggtccttaatgatataatcccactcttggatgagttgaaggtggcatccctcttgctggagagactaggatgaaaggcattttcttttacgtaggtgacctggtttttgttttcatgaattcagaaaggaattagtagacaacaggttctgctatctaattattaccataaagaagggttgctggatacttaggctaaattcgaagtcaacactttcggtataggctctccagcattcacttggcgtacagc

SEQ ID NO: 71274 - DNA, 356 bp, Homo sapiens
actgggtggtttataaacaacagaaatttatttctcacagttctgcaggctgagaagttgaagatcaagattcagtgtctggtgagggcctgtttcctggttcatagatggtgccttcttgctgcatgtctcctggtggaagggccgaagcagctcaccaggaactcttataagggcaaatcccattcatgaggctctgcccttacgacctgattcccttcctaaaagccccaccttctaatatggcacattgatgatcaggttttaacatatgaattttgggggaatacagccattcagaccatagtacctgggcctctgtttaatggatgtgacaccctcttctccccacagtc

SEQ ID NO: 71275 - DNA, 406 bp, Homo sapiens
gctggtcctcgaaactccctgacctcaggtgatccccccactgccttggcctccccaaagtgctgggattacaggcgtgagccaccgcgccccgcctaagagccctgcatttttaacaaaaggaacatgtgattctgaccccatactgaaaaagacatttgaaggacaagtaatttgttttaaaaatacagataatcatactttagctacatcacttcctgtgggatgttttcattttagagactcctttagaattccaagttgtgtaagcagggaacttagaggttgaatattatctgcttgaattccacctaaactactaagtaaaagcaaaacaaagaggacagcctccttaattgattctttgaatcaaggtcctttaaattgtcaccatagtttaggttcc

SEQ ID NO: 71276 - DNA, 253 bp, Homo sapiens
ggatcagggaagccagtcaccggcacagctttcacatgacagcttctaagaagtcagactcacaagaccttctcgtgagtctaagcaggtcaaaactcttttgctggccaatagtgggatcatgccttttagtagccactgcactccagcctgagcactatagtaaaactccatttcaaaaaaaaattataataatttttagtatctactgaatttgaaaatatttgtgacatcaatattactttaaacaaaa

SEQ ID NO: 71277 - DNA, 441 bp, Homo sapiens
agagaggctgttttctgtgtgcactttattacatagcaacacatcctttgtctgtttcagtttccttatgctgctttattacttttttcatagcacatctctccactagacaagtctgtctttatttttttgttgtttgttatgtaaggtccatgagaacatgcagtttgtcttattttatcttcattgcccagaatagtacattgggtagtattaaccattacctcagaatgactgaaccccccaccaagctctctagtgttgttcacagtttccccttgtctagagttccttgttactgtgtttaaatttggctcagcttttttcagcttactgaaatctatcatctctttgaatccttcagtgaacatcctggtctatagtgatcatctgtccccctacatttctggaggaataaaaaaatttacttgtctattatca

SEQ ID NO: 71278 - DNA, 747 bp, Homo sapiens
aaaaataaggccagacgtgggggctcatacctgtcatccaccattctgggaggccaaggcggaggattgcttgagaccagcctgggagacatagggagacctcgtgtctacagcaaataaaactagctgggcatggtgttgggtgtctgtagtcccagctactcaagaggcagaggtgggaggattgctcaagcccagcaagtcaaggctgcagtgagctgtgattatgctactggacctcctaccctggacaagggtagccgtgatcatgctgcgtggtctcctaccctggaccagaaagtgagaccctggctctaaaaaaagaaacacacacacaaatacacaaatatatatatatacacacacacatatacatatgtatacttaacataaaaattcaaggaaaatactgtattttattttacctattttattgtgcttaattatgttcaaaaatcctattctaactgcttgagctaggattgtgccactgtacttcagcctgagagacagagcaaaaccctgtctcagttaaaaaaaaaaaaaaaagccaggtgcggtggctctactaaaaaaaaatacaaaaaattagccggatgtggtggtgggcccctgtagtcccagctactcgggagcctgaggcaggagaatggagtgaacccgggaggcggggcttgcagtgagaccagatagtgccaccgcattccagcttggatgactgagcaagactctgtctcgaaaaaaaaa

SEQ ID NO: 71279 - DNA, 400 bp, Homo sapiens
gtccagttcacaccacctgaaaaactgagggcctcagagaaactgaggcctcagagaaacagagaaactgagggcctcagagaactcctgcaggccctccagctggccactgccagccctgcccaggaccccatatctcaccagttacttgtgtccaccctgtctccttgctccatcctaccccagtttagagagtgagaatgctggctgggaccccaaagacctatctgcaactccccaactccaagaaagggggggctccaacaaggcagggctgtaatgagatggaagatttgggctaatccggagccaaatgagggcctaattcctgctgtaaaaatctgtcagctgctagttaacagttcctctggccctgggcttgagggtgggggtggggggt

SEQ ID NO: 71280 - DNA, 480 bp, Homo sapiens
ctgaaatttgaataaagccaaagtccttaccatgacctgaaagaccttcatgatggggctgctgcgttgctttccaatttcatccacctctatctcccatgttaactactcatcagccccacacttgccatgtctgtccctggacctccccattgcagggtcttcacacttgctattctctgcctggaatggtcattccccagggctttgctaagctacctttttcttaccactcaggcttcccctgctaagtccactcctcagagggactttcaccgatggtccaaagtagttcccctaaccctccctcctcatcactctctttcccatcaccatattttgtttacaacacttatgacacttatgattctatgaaattatattttgtgtttccatatttatgagtgcatagactgagcacaagttgtaacctatcttgttcactgatgtttcccaaaagccaaaaacaagtgggtggca

SEQ ID NO: 71281 - DNA, 510 bp, Homo sapiens
agttgggattgttagaagagctagaaagcacagattgcactcagttggacaaagataaacagaaagcttgcttttttatgaaattggagattaaatgagttgatggaatcaagcctagacagccacataagccagagtggaaaattatagactaaaatgcatctgatactgaagagaatgactctctccaaaagccctcactttttatttgattcaaggagtctttataagctcagcaaaccctaagattttaacaagaaaaacaaaagcctccaaacagcatggctttcatccagcgcttttgtgatttacaaatgaccagatttaaaactttaatcatctcacacctagggattttttggatttgttttagtttgtaaggcatgtccacagacaaaatgactcacaaaaaacagaatcagcctaaacccccaattggccctattcctctgtcaaatcaagacagtcagttttgccctgggatttcagagtgtccccaagtggcccttc

SEQ ID NO: 71282 - DNA, 434 bp, Homo sapiens
acacactggtgaggacacgttacacatttcatatcactgagttcacacacacacacacacacacacacacacacacacacacctatatgagggcagtatgatttccccatgtgataaagaaggaaagggaagctcagacagattagatatattgtctgacattgttcagatagcaagaagcagattcaagatgcaagcatagaccagagaccattatttgagaccatgaggccttttctcaccagttattcattcacttaatattaatcacttaatatgcatttgctgagcacctgtcgatgtcttgtaaatcagtgcaggaaaatcataagatttgaaatcacagcatctaggttcatatctcagcttcatcattaaccagcaaaccagtaaacctccctgtttgcagtttcattatcaataaaatgggttga

SEQ ID NO: 71283 - DNA, 660 bp, Homo sapiens
tttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttgg

SEQ ID NO: 71284 - DNA, 632 bp, Homo sapiens
ctagatcttccagtgtttatccagcaccttctgcaggagtccttctactgaaccaccagaccctgtgggctcagggacaaacacaggaacaagcccacaggataatcacacagggtggtcctgggagggcctttgacaaggtgactttgagctcagacctgatgtgtgtagaggaagaaaaaaggcatcactccatgagagagaaggagagggataggagacccgggtgaggcaaggcagagagctagtggctgcaaaagagacaacactgaccaggaggggagggaatggagggctttgtggaggaggtagaattgagccaggccctgaaggaggagctggacagagaggaggtggtgcagaggaaccctgatttgggaggaggtaagccaggtggtaggcccctgagatacccattctccagacaccatctcttacaagggcctttggtacccgagaaaatgcacatgataaactgtcaagcgaaaaatacaagatacgaaacagacagcagctgtggcgttgcgaggggttgaactagaccatccgacctagcatgtagtaggcgctcaataaacaggagatcgatggaatcatgcttttccgatttgcagacaaatggggggatcaga

SEQ ID NO: 71285 - DNA, 389 bp, Homo sapiens
ggcctctacccctcttaaaagctggccatgagttcactgatgctttcttgtctgctctgacagctttatgtcggcaatcaattatgtagagttcccattttcttcttagctcaagcttattcatgaaactaaaatatgggaaagttgaggttatttttatcaaatatgagaaatttcctgatgatttcatattggatttagtttctttctctctcttgttttttgttgaaaagctttgcagatgcagataaacattttgttttctcaacactgccatactgtacttataggatcttttggagttctttaaatgaggaatattagagaagtctaagctggtattatgggatttatagtaattttataatttatagtaattttaagattaa

SEQ ID NO: 71286 - DNA, 3022 bp, Homo sapiens
  misc_feature (542)..(542): n is a, c, g, or t
  misc_feature (789)..(789): n is a, c, g, or t
  misc_feature (1026)..(1026): n is a, c, g, or t
  misc_feature (1088)..(1088): n is a, c, g, or t
  misc_feature (1172)..(1172): n is a, c, g, or t
  misc_feature (2037)..(2037): n is a, c, g, or t
  misc_feature (2460)..(2460): n is a, c, g, or t
  misc_feature (2696)..(2696): n is a, c, g, or t
  misc_feature (2793)..(2793): n is a, c, g, or t
catcagcttcctgagaaacctttactataatggattgtaaaaataactactttaaggacaaatttcttaattgtaaatgctgcaaaatgaaggagcttgtttgggttgatgcaggacccacagcaattaaacaattgctgacgagtatatgtgatccagatgcacaggaggttattcttgcaaccagcctattggaccagatgatcttggtaccacccagatcaataaactggctcatctgatcttgtggcaccccctacccaggaactgactgagcgcaagaagacagctttgactccctatgatttaatctctaaccaatcagcactcctggctcactggcttcctcccacccaccaaattattcatagaaactctgatccctgaatgctcagggagactgatttgagtaataataaaactctggtctcccacacagctggctccatgtgaattactctttctcttgcagttcccctgtcttgatgaattggctctgtctaggcagtgggcagggtgaaccccttgggcggttacagtgntatgggacaaaattaagatttggtggccattgatgttgcctctggccacatctcctctggggagaatgtaaatcaaaaataaaattggaaccctcccccacccccaaccatcttaatggactcccttcttggccagggcactaaaatttaacctgaaagactggtcaggctggccggcgcggtggctcatgcgtgtaatcccagcactttaggagcccgaggcaggtggatcgcctgaggtcagganttcgagaccagcctggccaacatagtgaaactaaaaaatacaaaaaattgtctttactaaaaaatacaaaaaattagctgggcgtggtggtgggcgcctataatcccagctacccaggaagctgaggcaggagaatcacttgaacctgggaggcggaggttgcagtgagctgagattgcgccattgtactccagggcaacaagagcgaaactgtgtctcaaaaaaaaaaaaaaaaanaaagaaagaaagaaagactggtcaggccgtaatgggaactgggagtcagacaggcttcattntacccctccagcattaacatcaacagaccttaagtgtgataacaattacagtctattttctctgaagcttgctacctggaggcntcatctgcatgacaaaaccttggtcttcataacccttatcttaacccagacactcctttctactgataataactctttcaaccaattgctaatcagaatatgtttaaatctaccgatgacctggaagcaccttgcctttgagttgtcccacccttccagatcaaaccaatgtaaattttacatgtgttgactaatgtattatgtctccctaaaacgtacaaaagcaagctgtacccggaccacctggcctcaggacctcctgagtctgtttcactggtgcgtctttaatcttggcaaaataaaatttctaaattgacagagacttgtctctgatattttgagttcacaaaggtgatattgttggccaaatgtgcctcttactatttttttcttttcaatagcttctgcttatgtctgtcactgcttcttttgctactactaattattttaggtgaactcagactagttttacttctggatagtgatgtgaaaactgagattatcagaagtctgctctctgattcttgctttacttggactagaccttttttagacaccatagtattgtacattaatctccactagtataaacttcgtgagtcaggaacacatccccagagccctggcacaaaaagaaatcttgataaatattgtaaaatgaatgaatttactttgtgacatttcaagtttcttgaggacagaaacagtgtcttactccttatgtccctttaaaatttaatatattttaaaatatttgagtaattttttgaataggatatatatatcatatgtatatcatacatggcacaaatatgtgtgtgtgtatatgtatttgtgctatatatatatatttgtgctctctctntatatatatagagagagagcacaaatttgcaaaggtacaaagaggtatacggtgaaacaggaaacaggaatccctgtccaccagccacccagctgagaaaccctcctggagcgaacatcattattcattttttggtgtctctttccagaaatgttctgtgcatgcacaagtatttacatacatatcttcaaatgcaaatggtagtatactttctagatacttttttacattgcatttaacattagaacatgtagagcagcctcgttccttttaaagactgcaaagtattcggaatggacataccacatttaaaaaaaactagtcttctattgatggacctttatattgtttccaaagttttgctgttttggaaaatgctactgtgaatttccttgtttgttgctttacaaattggcagatttntctgtagaataaattcctacaagtgcaattgccggcttaaagggtactatgtgtgttttacgtattgagagatattggcaaattggccttaaagagttctattgactatttatagttctactaatgatttatacagtattttgttaacacggccttttggtctggaaataattacactgtaagacagtacagttgaaatatcaaagaaattaaaacaaagttaggtatgtcataantatatgaaatatgtgtagacactagtccattttatcatttgctaccataaaatatgcacacatctgttatacaaagttaaaatttatcaaaacatanaaacacagaacatgcatagcataatttgtggttgagaaatgtaaacaagtgtaaagatgcagtattattacgcatataataactgtagtccatgctgtactactgtaataattttgtagccacctcttgttgctgttgtgactcactcagtgttgacactcatcaccttcttgtgaacagttcatctcttcagtaaattgtgttttaacattaaaaagtgatctctcgc

SEQ ID NO: 71287 - DNA, 3561 bp, Homo sapiens
ctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggccctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaggcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaa

SEQ ID NO: 71288 - DNA, 854 bp, Homo sapiens
ctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgagggtctggattgaccagttggggacaacctctattgggcctgcagaaccaggccagaat

SEQ ID NO: 71289 - DNA, 2431 bp, Homo sapiens
caagcccttgttgtgaaattcctgcctgctgtccggaactcagtcttcccatccgagggacgaaggtttcgggaagagaggtggacaggaaggggtcctcatcagcggtcccaccctcctctccttccttcgccctctccaggccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggccctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaggcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaa

SEQ ID NO: 71290 - DNA, 3336 bp, Homo sapiens
ctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggccctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaggcttaaaaagttactcggtacttgttttaaaaattaacttcccaggaagtgagttaaaaacaataaaagccctttcttgagttaaaaagaaaaaaaaa

SEQ ID NO: 71291 - DNA, 419 bp, Homo sapiens
ggcaccagcagagaggagcagagacgcccagaacacactgtcccccaatgccagccccaagcggggccagctcagggtgcggtgggcagagccatcctgcagctctgagatccgcaaggtggaggtgggagtagcgccaggctccactgtgttggagcttgccccgtttgagcccaatttgattccggagccatgacctgcagcacattggcgaccagaagacacccaaagctctttgtcctgggaagagtttgctgcatcttccagtttcagtaatcaaagaagcaaagttccctgcagttcttcaaggaaccttgagaattcagaaggtcttggggtggctgcatccatcctgcagacaaatgccaatcagcagaggggccattcccagggacacatgtctggctgacttgggcctt

SEQ ID NO: 71292 - DNA, 376 bp, Homo sapiens
tttggagacatggattcacgttgttgctcaggctaaagtacagtgggcatgaacacagcttactgcagcctcaacctccgggactcaaacaagactctaacctgacccttcaagtagcagggacatcaggggcgcccatcacacccagctaatttttttttttttttaaagacagagtctcactatgttgcccaggctggtcttcaactcttgggctcaagaaatcctcctgcattggcctcccaaagtgctgacattagacaatttatgggcctgtgcctggcctataaatggctaacattatgtttataatttttatatcaatgttaatgagagatgggtctattttattgggtgttgatatcaaaggtttgct

SEQ ID NO: 71293 - DNA, 265 bp, Homo sapiens
cctgaggccagtcagcctgtcagcactggcatacctgcagagagctcctaggacagtggtgatcagacaagttgtgcagttctgatggagaggttttcctgagcatttgggtgtcctaattaaatacagccttatttcatgataggagtgactcagggtcaaaggcaatgggaaatgctacagagaacacgactgcaacaccaggaaggctttggaaaggcagaggctagtgttgcagagaaagagcccaggcaggggattgcag

SEQ ID NO: 71294 - DNA, 449 bp, Homo sapiens
aaaaaaaaaaaaaaaaagaaagaaagaaagagcaagggatgtccttaaccagaaaaatgatatttattttttcattttcagcaaacatcatacttaaaggggtaatgcaagcatttattttaagctagtggaactgagtattactactgctactattcaaaattgaactggaagttttaattagaacagtaaaagagggaaaagacatgaaaagtaaatgtactgactgatactacctgacttcaaggcttactgaaaagctaccagacagtgtggtataagccaaagaataaataaatagatcagtggaacagaataaggagtccagaaatagacccacacagacatagtcaattcttttgaaaaaggtgcaaaggcaatccaaaggagaaaagataatattttcaacaaaaggtgctggcacaacaggacatccagaagcaaaaaag

SEQ ID NO: 71295 - DNA, 582 bp, Homo sapiens
gaaaataagtcagactctctcatttggccatattgaagctaatagtctcagaaccactgtgtcataacactgacattttgcttaaagctctgtatcacctttaatggcttaaaatattctagactgtattgagatcatgcaagtagatcaaagaaagagaattacacgcaaaggaagggatagctgtactagggagttcactggtaacagagtcaggggtccacagctctgggctgggtctgtcctgaaaggcagtctctggatagcaggatgagatggagtgatcactggctttggagtcagacacaatagactgagctatgttgaaggacaatgacaaataacacaatagatagcattcattgaaccctcactatatgccaggccttatgctaagctctttatgtactttatgttatgcaattttaataactaccctgtttttattagtattttatggatgagaaaacacaggtttagaggttatcaaatttgtccatgaccacatgaacttgtaattcccagtaaatatttttgtaaataaatatctgaaagtgtccaggcacggtggctcatgcctgc

SEQ ID NO: 71296 - DNA, 1418 bp, Homo sapiens
tcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgagctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataattttaaaagtagtatt

SEQ ID NO: 71297 - DNA, 1447 bp, Homo sapiens
tcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataattttaaaagtagtatt

SEQ ID NO: 71298 - DNA, 1245 bp, Homo sapiens
  misc_feature (180)..(180): n is a, c, g, or t
aggccaacattcttttccacactgcttgtaagtatatgcatgtccatcccagctataccatggttacagaacaactgcctaacaatgatggctgatccctgattgcccctcaatcaggcaggaagctcaggcagttaccctacagaaaggtgcttgcagaaaacactggttatttgaacnagacaagtgcatgggagccaatgctatccccagaccttggtgtgaagaaggaagatgctcaagttagtagatgttgcttcacaaaggtctcttctgttccagctccatgcaggagttatgaatgtgggtttttttaatcactcatgtgacttaaatgcaaactttgccacattttttattaaatgtgtacatttgggcaagttccttaacctctctgtttccttatctgtaaaatggggatgataaactctacttgtggatgtccttgttaagattacatgacttaatgtttaggaacatttagtattgtgtcttgtaagtgccccacaagtggcagcagttattgtttttattaacagtcgtgatcatctcttcaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataattttaaaagtagtatt

SEQ ID NO: 71299 - DNA, 1396 bp, Homo sapiens
tcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgagctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttatggggggaaggggggggggcagggggggacgggagtggagggaagttggaaggggggggggaaacag

SEQ ID NO: 71300 - DNA, 1050 bp, Homo sapiens
tcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgagctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactaaataatcacttccatcaaggataactctaggattgctct

SEQ ID NO: 71301 - DNA, 785 bp, Homo sapiens
catatttgaaccaaatgttacattctagccattgatatcatctaagtaaaactaacattggctctaaaaggtgccgaataagaatcaaagtgtagaatattcttacttcctcaggaaaagttactgaatatatagtcatgaaatattcaaaagtaaagttctaagaatgattctgaggcttgcctagaagcagaattctaagatgatggctcttttcattaaggagtgtttattttaatttcttcaccccactgttggttttggggggtttgtttttgttttgtctaattacaaatccctctcctttccctgaagggcatgacgaagctttgttcatctctgtacctccagctgccagctcaatgcctagcatattgtggacattcaatatatatcaacttactgatgatcattagcataaataaaatttttaaatatacaattttttctttggtgagatccgatgtgttctaataataaaagtgagaatctttcaagtcagctagagtgagtaaatgttgttttgcatcaaaaataaataaataattaaattacaaggcacaggaaaccaagtaaaagtattgcttgtggtgctggtggaaaggaaaggacttccagaccaaggtacagtattttgattactggagaagagagaagaaacctgttagtgctttggccagtattgggtcaaatgaaatgcctgtggcccagtgtgaatcaccagagtatcttgctaaaatgctgattctaactcagtgggtatagggcagggcccaggatccctt

SEQ ID NO: 71302 - DNA, 468 bp, Homo sapiens
aggtcacacagccagcagggggcagcgctggcacgcaggctcagcaggttcaccagcactctgcctgccgccttgcgcctccctaccgcatcttctccaacccatgctgctgcagatgaggacacaggtcttgaacactcacatgcttttgagaggccacatagcaagaaaacagcagagtcagggtcacaactggtctgactcctgtcccagggctcccttctttaatcctatcattgtttctgctcagcctgtctgtgtggcggacttggagaagcctgtgaggcccaccaggatgtaagctccatgtctgtcctcatccatcctgcatgtccggtgcctgaatcagtttctgcacagtgaatgcagttgaatgaatgaaccaatgagtctctgccatcatgacgcatcctcaaatgggagagctgatgccacctgtggggcgagggatataaggtcggagatgat

SEQ ID NO: 71303 - DNA, 364 bp, Homo sapiens
ccgcccacctcggcctcccaaagtgtgggattacaggcatcagccaccgtgcccggcctgtgttttatttttaattataattcttttcttctgttatagcaatttatggcgttttaaacattcagtaaattaactcataacaaatactgaaggcctttatactaaatacactgcactaggagctagggataaagtcctcagtaatacaaagtcctgccctaatggagcttacttctaatgtagaagacaagaccagtatgtaataaaatgtagtaagtgctgtgaagaaaagcaataacttactgaacttttgccatgttccagatggacactgttctaaacaataaatatgtgtaattattat

SEQ ID NO: 71304 - DNA, 361 bp, Homo sapiens
ttttttttttacaagttataataagcaccaccagaattcaacagaaaaaaaatgggctaaacatcctatgctgaggatagaattaacagtcatacctcagcttactcactatttatacattatagctgttccctcttcaaaatcgagactgaaagaatgggaaaatgttagactctaaaccatcatctattcaaagttacaatggaatataattgctactatagagcaagaacataaaccttaaaaatgtacccagggtaggggcagggagaaaagacatcatgatacatgctagtttaaagattttatttggaatgaattacataaactaccatatttcaaagactgggcttcattatct

SEQ ID NO: 71305 - DNA, 2649 bp, Homo sapiens
  misc_feature (1859)..(1859): n is a, c, g, or t
ttgcccacatttactaaaagatgagtgtgctggaaatttcaagtattatatgagcctctgatacctaccagtatttaaacaggatttaattatttcaacacttcacccatcaatcttcacttctcctgttcagataaaaatgctttcatcccaaataagtaaaacaagaacattaatagtgctaataatataatcttttcattggataggtctgagtttagcgtttgtttgttttcttaatgagatcaaaagttaaagaccaaggcagcaaaatattgtgaaacaagctgaacttggggtcagcatacatttgttcagtcttgtttcatttagtatgactttgggcatatcacttaaatctcttatctataaaacaagtacataaaagtcttgattcctgaagtgcctttctactttaaaatattttgtttaaaatatcaaacttcaatataaatatgttggaaaacaattctaatcaaagaacttctattaagtaaaacaagacaaaatgtgtgtaaaaatatgcctaacacatagatttccttgattgtattttctactgaactattttcaagtattcagctttatactaatatattaatctcaaaatacctttgtttcattgttgctactccttaaacttttttctttattatctagatctagtaaagttttctgcattcattgtattaatgttggttcaaaagtaattgcgtcctttgtcgttatataaattgttttataaatggctttaactatgacataagccttttaacataatcagctttctttaaaggaggaagtcagatgagtagagaaggaaagttatattcctttacaaatgctcttaattttaatgtcttaagggaattatagagacttccattattctgccttaaataagggatgttacttcagttttcttgtcatggctccctgcatgggcagtcatgttaacaagagtcagggagatagcagatattccataatagtgactgcagataggccagtcaaagtcattttgttttaaaggaagggaggttgctggtagttaggtgggaaaataacacctgtgaaaaggaagtccaagtcactggctcagggactttggaggcattttcatatcatattcactagtcaagaaacgtgtagattatatgtgtgagtgacatagtctgtttcaaagtattagaaaagagacaatagaatcacccaccctcccttcgacacacacttccttatgtaaaatcagaatcaaataattatcattcctaaccctcacagtgaaggatttggtttcatgtaacaatgaaagtagataatgggtcagacatggaaatagcaataaaagggaattacaacaagataaatgtgagtaatagttcattttcctgcatttttgatgagggccatgaagataggtcatggtaatctatggagaaggtccttaagagcatagaacaatataaatataatatgggccatatatataattttaaaattttctacagccaaatgttaaaaagtaaaaaacaattttaataatccagtagctccaaaatattattttaatatgtaatccaatatattgaagttataagatattttacattctttttttgatatctgatgtatattttacactttcatcacatctccattcagaccggctacaatttgatcagttgtcacatgtggatgactagtggctatgataatggacagcataggtttagacaatgcctattcaactattcaacttgttttacatttataaatctcaaaatgcctttatttcattgttggtactcttttttattacccagatacaataaagttttccaagtttcattgtacanatgaaatgagtttactgtggaaatgaaaatgcagagtaagtccaacagctagtttatcatcctgaacccagtgaagaaatcaaagctgaataaaagcgactcctagttgttactctcaagggcaggtataatttatgtgcaagactttgtagcataatgttttgcaagtagtggatgttcaatatctacaataaatgaattgtagtactatattgcttgaaggaagtttataacctgtctagaacaactttctcaattttacaactaaactaggagatccagggcttaaatcatgattgaactgattattcctgttaaatttatgtgtgaaccatatgtgaacattctttgaaaatgtatgataagcatttcaagatttctgttttaattattaacatttagaattctaggaaatcttttgggatacagagaacttatttcttccaactgttgcttcagacgctgataagattgtagaagatagggaagctgtagtttactatctagttttttaatgcacatgaagtaatttaaaatgctcttcttcctttcttgtcacatacttttaaaaaattctctaaagattgaataattttaagtatttcttaactgggcaaaatggaaactttgtaactgaagccagtcaaggtgaatacacagaaaatcattttcttattaaggtcagttaatgggataaaccgttttaagagagttgagaaaaaataaagttctattttaaatttatacatgtaactttaataaaaactaagtcagacaaaatttaacaaaa

SEQ ID NO: 71306 - DNA, 563 bp, Homo sapiens
ttaatctcaggagacctgattctctcttgctgagatgggtagagagaaatcctttggcaactaaacctgttactctagcattgtctctgttttccaaaaatcctgcttaagctttacttatctgtatttaatgtgaacctatccccccttattgttcttctgtgccacctcatcttaaagtctatacattgataggttctgcattgagttcttgcacttctctaaggaaagagagcaagagaattgtggaagtttggaagaagtgagggtaaagagactggatatctttccaagttaaagcagtttggagccaaggctgatggtaaagagaatattgcagaatttgttaaatatccattaatgagtagaatctggcaattcctggaaccatagttcgagattgagggtggaataaagatatatcagatacacccacaatcagagaatttaacacctatagcccctcattgaaagaaaaagtgtgggatgcaagaaaaatggtgaatacagaaatatgataaaaatgccagtaaattaaacaattattgactggaaacagccgt

SEQ ID NO: 71307 - DNA, 3864 bp, Homo sapiens
  misc_feature (1)..(2): n is a, c, g, or t
  misc_feature (4)..(4): n is a, c, g, or t
  misc_feature (7)..(7): n is a, c, g, or t
  misc_feature (56)..(56): n is a, c, g, or t
  misc_feature (366)..(366): n is a, c, g, or t
  misc_feature (369)..(370): n is a, c, g, or t
  misc_feature (376)..(376): n is a, c, g, or t
  misc_feature (411)..(411): n is a, c, g, or t
  misc_feature (470)..(470): n is a, c, g, or t
  misc_feature (516)..(516): n is a, c, g, or t
  misc_feature (667)..(667): n is a, c, g, or t
  misc_feature (674)..(674): n is a, c, g, or t
  misc_feature (684)..(684): n is a, c, g, or t
  misc_feature (716)..(716): n is a, c, g, or t
  misc_feature (815)..(816): n is a, c, g, or t
  misc_feature (878)..(878): n is a, c, g, or t
  misc_feature (1658)..(1658): n is a, c, g, or t
  misc_feature (1665)..(1665): n is a, c, g, or t
  misc_feature (1674)..(1675): n is a, c, g, or t
  misc_feature (1680)..(1680): n is a, c, g, or t
  misc_feature (1875)..(1875): n is a, c, g, or t
  misc_feature (1880)..(1880): n is a, c, g, or t
  misc_feature (1892)..(1892): n is a, c, g, or t
  misc_feature (2040)..(2040): n is a, c, g, or t
  misc_feature (2161)..(2162): n is a, c, g, or t
  misc_feature (2307)..(2307): n is a, c, g, or t
  misc_feature (2331)..(2331): n is a, c, g, or t
  misc_feature (2393)..(2393): n is a, c, g, or t
  misc_feature (2481)..(2481): n is a, c, g, or t
nngngcngggctgaatggtcgctgagacagagatggaagccaggacaagggagccnaccgggcccagatagagacttcagaacccactcctgagaacagcggagccaggcgcttagaggaagaccaaatgctgccaggacacggattgtccaggattacattccagcatcttattagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcngannggggcncacagctgctggtgggaggtctttggggcccaagntcccaagtccacctcaggtgctagaaacccctgctggtgtcatgaaccccttacagtgngacgggggtggggtggggtcctgacaaggcatgacttgttgggtgnggggtggttatttattttagagatgcacagggccttgctctgtcccccaggctggagtacagtggctccatcatggatcactgcagcctctaactcctgggctcaagcaatcctcctgtgtcagcctcccagatacctaggattacagatntgtgccncaatgcctgnctaatttttctttgtattttttctggagatgnggtttgctacattgcccagactggtctcaaacacctgggttcagttgtcctgcctcggcctcccaaagtgctgggattacaggcatgagccaccacacnngaacacttggggtggttttaagcccccagcaaggtgcaccagcaggaccaggaggtggcctnggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggagcctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctgatgggcagagcagccctcgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccctaagggtgatgcacaggcnacaggtnctgcacgcnncagcncccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagnaatanggatggggagcnctctggggatgggcaaggccttccaggataggctcagttttggtcccctgctttttgaggttgggttaaaattccgaccatggcagaggaagcacagctcgggttcccacacctcacttttcacagcctctgagggcagcagtgcacntggaggagacgtctcccatgaggccaaggcctccagtgctcaccgatgccctctgcgaagttggggtagaactcgtcagtgaagaggggctcgggcagctcacggaagtacagcttcagcnngcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccntggagcactctgagatctcatcgnggacaccactgcccacacctccatcccgtcctgcgcaggccgacactcactgacgttgaagnctgccttcagtgcctggatgtctgcggccaccccagacatgcggtagatgcccacctcctccatgcctcggcgctcgatctcctccangcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaaaccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaataggcttctcttggcaactgactcgtgacaaagggttcaagattgtttgaaaaaaaaaaaaggggggggggaacagggaggcagtaggtcctggaaaagtaaattctttattttacaataaaaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaac

SEQ ID NO: 71308 - DNA, 3007 bp, Homo sapiens
  misc_feature (801)..(801): n is a, c, g, or t
  misc_feature (808)..(808): n is a, c, g, or t
  misc_feature (817)..(818): n is a, c, g, or t
  misc_feature (823)..(823): n is a, c, g, or t
  misc_feature (1018)..(1018): n is a, c, g, or t
  misc_feature (1023)..(1023): n is a, c, g, or t
  misc_feature (1035)..(1035): n is a, c, g, or t
  misc_feature (1183)..(1183): n is a, c, g, or t
  misc_feature (1304)..(1305): n is a, c, g, or t
  misc_feature (1450)..(1450): n is a, c, g, or t
  misc_feature (1474)..(1474): n is a, c, g, or t
  misc_feature (1536)..(1536): n is a, c, g, or t
  misc_feature (1624)..(1624): n is a, c, g, or t
cgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcttgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacagaggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctgatgggcagagcagccctcgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccctaagggtgatgcacaggcnacaggtnctgcacgcnncagcncccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagnaatanggatggggagcnctctggggatgggcaaggccttccaggataggctcagttttggtcccctgctttttgaggttgggttaaaattccgaccatggcagaggaagcacagctcgggttcccacacctcacttttcacagcctctgagggcagcagtgcacntggaggagacgtctcccatgaggccaaggcctccagtgctcaccgatgccctctgcgaagttggggtagaactcgtcagtgaagaggggctcgggcagctcacggaagtacagcttcagcnngcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccntggagcactctgagatctcatcgnggacaccactgcccacacctccatcccgtcctgcgcaggccgacactcactgacgttgaagnctgccttcagtgcctggatgtctgcggccaccccagacatgcggtagatgcccacctcctccatgcctcggcgctcgatctcctccangcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaaaccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaataggcttctcttggcaactgactcgtgacaaagggttcaagattgtttgaaaaaaaaaaaaggggggggggaacagggaggcagtaggtcctggaaaagtaaattctttattttacaataaaaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaac

SEQ ID NO: 71309 - DNA, 781 bp, Homo sapiens
tgtcccaacctcaggcctccacatgtgacttctgcacctcatctctgggatggtttcagtgggtcctagattgctttctgtgctccctgggacagttggtggcactctgtgagactactctcaggtacccttacaagctactcttaattttccccgctgttctgcttgttggacatggcatcatgctgcaatgttaacagtctttcaaagctaagcgcggaggatgtgattccatccctggcagttcttagattccctcatgactataggacagagaggagactgagaaacacaagaagcaccagagtggttgaaaggagctgaaggttcagacagcaacctggacactaagggtccaaagccaagcccaaggtcaagtagctggacagagaaacagctgcaagcacagacttggatcctgacctgattttctgcagaagcaagtccctgtttagccttctactgcctccttttagaatgaagccagaccagtcctttccatcatgggctcctgtggaaaatgaccccagctcagctcagtagttgatgggacatctgattcaggttggacccagcccagacatctgattcaaacaatattcttctccaggaattttgtaaccagcactggtaaagggagggaagtgctccccagtggggagagctgcagaatgtgagacttggaaaccaaaggccgccatgttttctgtctcatgatggaatccaatcttctttggcggggaaaataaatgaagccaacaccagtaggtataagagagat

SEQ ID NO: 71310 - DNA, 1048 bp, Homo sapiens
tgtcccaacctcaggcctccacatgtgacttctgcacctcatctctgggatggtttcagtgggtcctagattgctttctgtgctccctgggacagttggtggcactctgtgagactactctcaggtacccttacaagctactcttaattttccccgctgttctgcttgttggacatggcatcatgctgcaatgttaacagtctttcaaagctaagcgcggaggatgtgattccatccctggcagttcttagattccctttggattacagaagtgatttttaaagacactattaatagaggtattttatcttggtacaaaattatttaaaaaatagacttaaacagagacttccacttatgggtataatagactaagaccctgttggatgatttcttcaccctgcatacaacaactgtgagactgcacgtaatcatatgatagtactggagactgaagagaagatgacaggatctaatgggggagtccatgcttgcttgaaggaggagagatatggatctggacaacatgactataggacagagaggagactgagaaacacaagaagcaccagagtggttgaaaggagctgaaggttcagacagcaacctggacactaagggtccaaagccaagcccaaggtcaagtagctggacagagaaacagctgcaagcacagacttggatcctgacctgattttctgcagaagcaagtccctgtttagccttctactgcctccttttagaatgaagccagaccagtcctttccatcatgggctcctgtggaaaatgaccccagctcagctcagtagttgatgggacatctgattcaggttggacccagcccagacatctgattcaaacaatattcttctccaggaattttgtaaccagcactggtaaagggagggaagtgctccccagtggggagagctgcagaatgtgagacttggaaaccaaaggccgccatgttttctgtctcatgatggaatccaatcttctttggcggggaaaataaatgaagccaacaccagtaggtataagagagat

SEQ ID NO: 71311 - DNA, 416 bp, Homo sapiens
tgccatatcaagtttaatcctcctgctacagacttcacatacgctcagaataatacatggactctcctgggtattggattagcattcctgatgactcacatcacagttgcagtcttgtgttttcttgcaaacagaaaggtaccaataagaggagaaatgtgatgctcagagggtgtggctgacaagctccaggacacaggtaataagtaaaatctagatctcgggtctttcaattgaaactagaaacataggaaacaacaacagaagtcacaacaatttaacagttatttagaggtgtcagtgatttgggatttaaaaatatggaatttaacatttctggtttcaaagtcaatacacagcttccatatgacactatagagtaagtaaaaaataaaagataatttatctgatgtaaa

SEQ ID NO: 71312 - DNA, 553 bp, Homo sapiens
tgccatatcaagtttaatcctcctgctacagacttcacatacgctcagaataatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatcaaatttct

SEQ ID NO: 71313 - DNA, 335 bp, Homo sapiens
gacgagacagtaggacaagcttaaggagccggtctactatttttaatacggtggtcaaggcaggattcactgaatagacctgaaggtaagtgaaattagccacacagctcagctgagagcattccaaagggaaaacgacaacttaaatgcttaatgacagagtgcttggtatagaggattagccaggtcaattcagctatagcgcagaagtcagaaaaattgagttaaaaacggctgcaggtacaatggggaggctattttaaaaagaaaaaagggaaaaaaaacctgttgcaggatttgaaacagtgctataatccatttcaaaatcagtaccc

SEQ ID NO: 71314 - DNA, 946 bp, Homo sapiens
cctgtgggccgcatccacagacacttgaagactcgcaccacaagccatggaagggtgggtgccactgctgccgtgcacagggctgcgattccggggtacctcactgcagaggtgctggagctggcaggcctatgggtgatagtggctttaaatgtttggctgattctgtctggatctccttttattgataattccaggaacttgcttggccccaagtgtggaaggctccagcttccttccccgccgcaggatcctattacttctttgttctgtttgaactctgcagactctaaagtgaagtgagtcggtggaaaacctggctggatctcaagaatacagcctgcgtctgagtcccatgaatctccccgcagcttaaggcctcctgtgagcagagcggatactgtaaagccctctcaaagacactaataactagaagtgggactgtagctccaaagtggcttttttttcccctttcccccgtgtaacttgctggaagcacttcgtatttctttatttctttgtggaataaaaaaaatttgtttgtaattccatgagaattagaaaggcttgtctcaacttctgagttggtacttgacattcagatactaaatttactagaggaagcacttttgctagattaaccaacgatggatttttcttcacaattgcgtgttaatttgctccctctttgagatgtcaatttttggttttagcaacacagcccaccccatagatcagcagatctgtgagtgtggattcagttgttagcatcacggggcaggggtccctggactgcatgtgcctttgtattaattgactagacttgcagttatattaattctacttgtggttgtttaaattgtgcctacttgcaccttacttgttgagtcaagataacaggggttatataaacgagtttataatatatttggcttatcctgctcaa

SEQ ID NO: 71315 - DNA, 209 bp, Homo sapiens
tctgggtgccgataccttgtcctcctcttgcctcttcaggcctatgggtgatagtggctttaaatgtttggctgattctgtctggatctccttttattgataattccaggaacttggtggtggcagaagtgggatccaaagtagagcttctcgtaacccccagaagcactgagtgaccaagtgtgacaccagctggactcattgtgtcc

SEQ ID NO: 71316 - DNA, 199 bp, Homo sapiens
  misc_feature (7)..(7): n is a, c, g, or t
  misc_feature (28)..(30): n is a, c, g, or t
  misc_feature (38)..(39): n is a, c, g, or t
  misc_feature (41)..(41): n is a, c, g, or t
  misc_feature (46)..(47): n is a, c, g, or t
tggcagnccgccagccacatggagctannnctgagcgnncnttgannaaaattgttgggttagtctttattgaggtcagctgtaagcgtaaaatacacactggatcttgaagacttagtgtgaaaaaataatgtaagatgtctaaataattttaatgtatcttaggtttattgagttaaaataattattaaaataattt

SEQ ID NO: 71317 - DNA, 754 bp, Homo sapiens
ctcacaggacagccttcaaaactgcactccatgccccggagaagtgtgactagcacagccggttctcccaggaactccatctgggaagaagttggggttcatccaccacacctgagatgcctgtaatttggatcccaccagcatgtccgtaggtaagatgtgtctgactcctgtggaagtcatgtggaaagggaggcctgagttcggggtccttgtgtggatccagaagcagaggtaagatgggaagcctcagccagcctcctaagccgtcctctcagatctctgcacacctctcacccacaagcttttactccacataaacccagatgccctcattcacagcacagaaagcacacaaatcctggagtcagagggacttgcgtttgaatcccagctctgccactcatcaatcaggcgaccttgggtacctgttttctcatcataaacaaagggggtaactggccgggcatggcagctcacacctgtaatcccagcactttgggagatcgaggcgggtggatcacttgagctcaggagtttgagaccagcctggccaacatggtgaaaccccatctctactaaaatacaaaaattagctgggaatggtggcacgtgcctgtaatcccagctacctgggaggctgaggcaggagaattccttgaacccgggaggcaggaggcggaggttgcagtgagccgagattgtgccactgtactgcagcctgggcaacagagcgagactccatctcaaatta

SEQ ID NO: 71318 - DNA, 417 bp, Homo sapiens
gcaccccagccaggggtagagatcattccctgctgagcaatcccttttcctgtggaagaccactcttcacagggtcctgcgcctccccagctcagactcagggacacagcacatctgcctagggcagccgtggaaggacatggaagggtgtaaccatgctctttccaaagaatgggcacccctaactctctcttctaccccactccggtaaccccatcctcaccagagaaccccatctctactaaaatacaaaaattagctgggaatggtggcacgtgcctgtaatcccagctacctgggaggctgaggcaggagaattccttgaacccgggaggcaggaggcggaggttgcagtgagccgagattgtgccactgtactgcagcctgggcaacagagcgagactccatctcaaatta

SEQ ID NO: 71319 - DNA, 327 bp, Homo sapiens
gttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaa

SEQ ID NO: 71320 - DNA, 1129 bp, Homo sapiens
  misc_feature (1128)..(1129): n is a, c, g, or t
tggggggcgccctagaggatccgagaggtgggacaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacgcccaccgcctcctccacccgggcaactgctggcaccctcaaagtgctgaccagcacgaccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctccactccagagactgtccacacctccacagtgcttaccaccacggccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggann

SEQ ID NO: 71321 - DNA, 5504 bp, Homo sapiens
gagtgagtcacctgaccgctgccctcgccgcccgccgggcgctctcgcttcagtcagtcgggccgcgccgcgcctcagctctggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggcgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccacaagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacactcaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgctcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtaaaagatggcatactgattataaaagaagcagaaaaacattgatttttttatatctttcataatataattttctaacaatgcaataaaaccactaaacttttgtgtccata

SEQ ID NO: 71322 - DNA, 476 bp, Homo sapiens
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggtgagagtgggcgttgattctggagacaccagctttgtgctcgtgtaatgtaacacgagtgccgttgctttctcattcttacacggcagtttcatgtcattgagtagaattgtgcggaatgcttttatggagtgaggcttctgcgttaaacttgtgctgattccaggtaaagtgtagtagtaattgtgaaagaacgtgtatgaggaaaacgagctacaatgtcatgcttggaggaacaaagaatgttttgtaggatgctttgctttttggagaattgttcggggcctggactg

SEQ ID NO: 71323 - DNA, 5767 bp, Homo sapiens
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggcgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccacaagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacactcaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgctcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtaaaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaagaa

SEQ ID NO: 71324 - DNA, 5704 bp, Homo sapiens
gcaaaagactgttgaagtagagagcattttgcccagctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggcgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccacaagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacactcaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgctcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtaaaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaagaa

SEQ ID NO: 71325 - DNA, 5628 bp, Homo sapiens
tgcctttggacatcttgaagaagcttagggaagaaaggctcccggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggcgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccacaagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacactcaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgctcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtaaaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaagaa

SEQ ID NO: 71326 - DNA, 613 bp, Homo sapiens
tttttattgttgctgttgttgttttgtttgtgactttactctttcttactgcttgcttttctcattgatatttcaggaagttttgtttactgactttgttctgtaccccctcatggaggtaaataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgttta

SEQ ID NO: 71327 - DNA, 495 bp, Homo sapiens
ttcccacgctctcttttcctcattctccacctccagctccctggcagccaggcaagagacagaagagccttctctgggattcctgatgcatatagaaaaaagatctgaagatactgtcatttggcaagtcccggtgaaaaagccatgtaatttccctcttgtgacacctgtcagtcacaagccctacccctcaaataattttctatgaattcatcactaagtatgaatactgagccagggatcaatagacttttgaggaaagtgccaagaattgaaaaatgatagagatgaaaactcctaaaccatggaaaaaatagaaactcatggaatagagaaaatgccacaaaaactaccaaaaaaacaaaagccctaaattcagtattttcagagaaataagaatatactgcatcaatgaaacaagaataacatgccatttaaaaggcacaagccaggcacagtggctcatgcctgataaagtgagaccctgtctctacc

SEQ ID NO: 71328 - DNA, 4731 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71329 - DNA, 4521 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71330 - DNA, 4443 bp, Homo sapiens
attatttttatatgaggcagttatatgtgcgaaggagaggaggggctaggctggagaccactctcttaattctccaccgctacaataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71331 - DNA, 3999 bp, Homo sapiens
tttttattgttgctgttgttgttttgtttgtgactttactctttcttactgcttgcttttctcattgatatttcaggaagttttgtttactgactttgttctgtaccccctcatggaggtaaataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71332 - DNA, 1707 bp, Homo sapiens
  misc_feature (16)..(16): n is a, c, g, or t
ctcgaggcccaagaantcggcacgagtaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71333 - DNA, 2124 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcctttttttttttttttaactagagtaagcatatctgttttgtttgattctcatcttcttaggtaagtttaaattaacctttgttcatctttctagagttttaaataattaaaaagtcagtgcagagagtgaaaacaacatggcatttggaatcaagtacatccaggtttgagtcatgcctgaa

SEQ ID NO: 71334 - DNA, 1345 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgttta

SEQ ID NO: 71335 - DNA, 4477 bp, Homo sapiens
  misc_feature (4370)..(4370): n is a, c, g, or t
  misc_feature (4379)..(4379): n is a, c, g, or t
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaacnctcgttttnaaattcaagaaaaattgtgtttatctttagaattttgtattcaatactttatgtactatgtgcctaatgcttctggataaataagcaccaaatatgta

SEQ ID NO: 71336 - DNA, 4841 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatactccctggcagccaggcaagagacagaagagccttctctgggattcctgatgcatatagaaaaaagatctgaagatactgtcatttggcaagtcccggtgaaaaagccatataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71337 - DNA, 4645 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccatttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattgaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggaaaaaatttcccggggggggccaaccacagatgagaccagcagaccacccgtactgtatgttgcagaaaggagggggccccccccagaagaaaggaggttcatataatacaacaggcgagaggaggcgcggcgcggtcgctaacaaacaggacggtcgaggaggaagcaaaaaaaacgagcagcgcgaagaggagaatcattttagtgaggagacgcacaccaccctggggggggggggaacaaatcaagggaaacaaaaaccaacgaagaaataaagagccgcgggaagacacaa

SEQ ID NO: 71338 - DNA, 4227 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagatacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagaccgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaatttacgtcttctattgaggggcaaataccattatgatacaatatactcaccgct

SEQ ID NO: 71339 - DNA, 625 bp, Homo sapiens
tgcctgggcaatatagcgagacccctttctccagaaaaaggaaaaaaaaaaaaaaaaatcgataccatcgacctcgaggaggggcgggcacagtcgggcggggagctcggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatagtgagtatttgtaagaatactcattttaattgccatggggaattttttatctgctttatagtgaaatcatagactttattttctccttttctatacatgtcttgtctcttactgaattttaatgaatactttattaaaaaaactagtgtgctaatattttcatatattaatttcatttacaaaaaaatgtgcatgggtttatccctttaatggacttaatttttagcaaggatagaattatgaggctcccacc

SEQ ID NO: 71340 - DNA, 1385 bp, Homo sapiens
gatgaatactttaaatacaagaaaaagttgaattgcagaaaagaagaggggctaaaaaggaagaaagttttaattctcaacaagaaacactatttagatggaaagcttaaatgtattcttattaagggtatttgatgatgcattttatttgcaaaaataaccagtgggtaattttttctctgaaaatttagctttaataagtcgtaaaatttcctaaagattttggagacgatatttcgattataccagctcttgcttttattttgggagcctggagaaatgagagtgattgcacctgtcaaattttgtatctcatcacttttggatcatcacactgtgactaaaatgacttcagcattttgttggccaccacagtgaagaactattccctgaaagttaatcagttgcctgagagacttttctgctactgaggggaaagaaaggaaagctttatttacctctaatgagctccgttccaagtcagttaatcactgttcccttacacccaagagtttcatcagtatcagagtcaacttgtcaaaacactggttctcagacgtttttttcagagggacttcttttccccacatggccagatttctttacaattaagaaaataagagctacagcgtattcttggttaaaaaccagtttagatgatgttaccaaatgaaaacaagtctgtattagcaaatgccacattatatttagtcgtattctcactaaattctccgttattaaaatgatttctgcatcttgcctggaaaatgcacttacatatttacaagcgttgtatgtcaatgtgcatgttttgaatttcctaacagtgtctaatcttagtagtttcatagtagttatgtaaaatctctttaactgcaaaatactataaaatattacttgaaatattaaagtattagtgccatttctagctgtggcaaggcacaagtcttactatagcttacttatgtcttctcatagatttcagtacagcatctgagtagtggatctgtttactgacagtatacacaaactaggtcttgacctcacttctttcttcatttaaaaggagaagatttgaaatagagctagtgtaaataataaataaaattatttaaatagcatcagtggctcaataccatctgttgaggaataaaataatttggttaacatacagaacatcgataatatacaataatgactttttaaaaaatgagtctgatctttttggctcacctagcttcccttaataagaaaatttgagaaacttggatctgaaaagtgtagttgtacttcctaacattaaattcctggctgtaatagttaatactttggcagcattatggttagtcttgtttatgccattggcacttactaggctaaacttt

SEQ ID NO: 71341 - DNA, 399 bp, Homo sapiens
atatatatatatatatatacacacatacacacacacacacacacacacacacacacacacacgcaagatagcattctgctttgatgagaaaactgagctaatctgagtgaaacaaaaacagtaaatagactagaagccagactggtattttgcatcgtgtatgcttgtttgaaaatctttgcttctgaagtaaatatttggcaaccacagtgattagcagttaaagtaatttcaacaaaataagaagtcattaaaaatggactgtttgtctgaaagagcagtacctatattataaagattgaatttcgtggctcatcacaaccattttcaaaatttaactcctactatcttcttataaattaagagaatttcatttgtgttccatagtgcaatgacaaa

SEQ ID NO: 71342 - DNA, 1304 bp, Homo sapiens
tatttaataaatggtgctgggaaaactggctagccaaatgtagaaagctgaaactggatcccttccttacaccttatacaaaaattaattcaagatggattaaagacttaaatgttagacctaaaaccataaacaccctagaagaaaacctaggcaataccattcaggacataggcatgggcaaggacttcatggctgaaacaccaaaggcaatgggaacaaaagtcaaaattgacagatgggatctaattaaactaaagagcttctgcacagcaaaagaaactaccatcagagtgaacaggcagcctacaaaatgggagaaaatttttgcaatctacttatctaacaaagggctaatacccagaatctacaatgaactcaaacagatttacaagaaaaaaccccatcaacaagtgggtgaaggatatgaacagacacttctcaaaagaagacatttgtgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagagaatgtggagaaataggaatacttttacactgttggtgggactgtaaactagttcaaccattgtggaagtcagtgtggcgattccttagggatctagaactagaaataccatttgacccagccatcccattactgggtatataccgaaaggattataaatcatgctgctataaagacacatgcacacgtatgtttattgcggcactattcacagtagcaaagacttagaaccaacccaaatgtccaacaatgatagactggattaagaaaatgtggcacatatacaccgtgcaatactatgcagccataaaaaaaatgatgagtttatgtcctctgtcgggacatggatgaagctggaaaccatcattctcagcaaactatcgcaaggacaaaaaaccaaacagtgcatgttctcactcataggtgggaattgaacaatgagaacacatggacacaggaaggggaatgtcacacaccagggcctgttgtggggtggagggaggcggggagggatagcattaggagagatacctaatattaaatgatgagttcatgggtgcagcacaccagcatggcacatgtatacatatgtaacaaacctgcacgttgtgcacatgtaccctaaaacttaaaagtataatataaaaaataaattcttacttgaattgtgcaatttgtagaactttaataaaaaaatgatacatctt

SEQ ID NO: 71343 - DNA, 581 bp, Homo sapiens
cattattcatatatatctgttttatgcttttgggggctttctccctaattttatctgtgcctatttattgaactacttattatacagattgagcatccctaattagaaaatccaaaatgctccaaaatcccaaactttctgaacactgacatgctcacatgaccattgcagcatttcagattttggattcttggattagggatgctcctgcattctacaaagattcaaaaatctgagaatatctgaaatctgaatgcttctggtcccaagctgtctaaataagggatactcaacctgtattgattcgtgtgggcactaagctacttatttttctcaattagttttcttcttcctataagatgaattgaggctgcgcgcggtgggtcacgcctgtaatcccatctttttgggaggccgaggcaggcggatcacctgaggtcagaagtttgagaccagcctggccaacatggtgatacttcatctctattgaaaatacaaaaattagctgggcatggtgtcacgcatctgtagtcccagctagccaggaggctgaggtgggagaatcacttgaacctgggaag

SEQ ID NO: 71344 - DNA, 283 bp, Homo sapiens
cattagaaaaaaagagcatgtcttactgttctgtgaatatactaagagttgtgagcagctgccatattggtggagtagaaaaccatgaggaggccaggcactgtggctcacgcctgtaatccaagcactttgggaggccgaggcaggcggatcacgaggtcaggagattgagaccaccctggctaacacagtgaaaccccgtctctattaaaaatacaaaaaactagccgggtgcggtggtgggcacctgtagtgccagctacttgggaggctgaggcaggag

SEQ ID NO: 71345 - DNA, 696 bp, Homo sapiens
cgctggattctcgggtgcccggctggtcgagggactgcaggcatgcgcccttggccagatctctgccctctggctgccctaggatgtcgagatggagtcaagtgactttggccccagtgtcttctaatcttcctttctacccaccccccttaaccagtgcaccctcccccaaccttgaaaatagagaaacaaataagcgcaaacactttgcactcatgcagacaacgtcttaaatttctaaagttatcttcttcactaaagtcgagagcacttttaggctaacaagctgcctgcatttgataacagggaggtagaaaaggggtgaaatgacatctacaaggtcactcgcgaaatcagggcacagggggccttcaagccccagtctcctggtttccagctttcctctcttcttaaacccggccgaagggggtgcccctgagaccactggcagtccaggcagttgttcattcctagtaaatgtacctgtttattttgtccttatctttccttcctcttccattgtgccacccatctagtttctcctggcctgtacctgaggcctgcttccaaggatgtgcctggcccactccccaaggtcctcagcagtcctgtatttcgggccctgcttgcagtgggaacccaaatggtacactatcctcctctttactgaacatcattaaaattctattttgaaat

SEQ ID NO: 71346 - DNA, 419 bp, Homo sapiens
gtctcaattcattgaattagtatgcatggactttcctatagaagaaccactttaaaagaggcccacctgcattcattccctctctggttgttcagggtcaaacacctgggcacctctaactctgagcgcatctgtactggttggcagtgtgcccattgctctatttatttctagcacaagactccagacagtggaataatttgtctgctatgcagccaagagaggattccaacagctggtgcagggtggaactggctcacttttgaggtccctgaaaaccctaggactgcatgattctttgaacaatgagtatgttttagagataaccatgaatttccaacagggctttaaagtaacccttccccaaagggagcacagacatgtccctaagcccaaggaacttaaaattttatttaaaa

SEQ ID NO: 71347 - DNA, 383 bp, Homo sapiens
aaccttttttttttactacagattttaaatccaattcttaggagcaacctggagaagaaagggtactttttgaatgatttaaatctttgggaaatggggataaggcaggttgtttgttggagtaaaaatacattataggctgagcacggtggctgacgcctgtaatcccagtactttgggaggtcaaggcaggcagatcacctgaggttgggagtttgagacaagcctgaccaacagggagaaaccccgtctctactaaaaatacaaaattagccgggcgtggtggcgcatgcctgtagtcccagctactcaggaggctgaggcaggagaattgcttgaacctaggaggctggtcgacgcggccgcgaatttagtagtagtag

SEQ ID NO: 71348 - DNA, 272 bp, Homo sapiens
tccgcacggtgggtccacccagggagctttaacaactgccaatgctggggccccagcttctccacttgtgatctaaccggtctggggtatgggctgggcttcagaatgttttaaagctccccaggtgacactaatgctcagcagtttgagaagcactgatgtggatgaaacgataataagtaaccagtggcaatgtggagaatttcagccaagcaataccctcatagactcctaaaaagcctgaatcctggataaactttcaaatcacagaa

SEQ ID NO: 71349 - DNA, 299 bp, Homo sapiens
attgggagaagcaaaaacaaagaaaatgatacttgtacttaaggtctgtattactttagttctttatttctaagcatatacaaaactcagacagagacatgtacatgcacacagactcaaacatggagttggatcttaaacaatttatctgtgactgatctgtgatctgctgtgatggatttatagtttcaatcatgtcattcattttaagacaatttttacattagtcatttaacagaccatttaggtgtctattagtcatctattctacctagctacagtacaatgtgttgtgacgt

SEQ ID NO: 71350 - DNA, 1490 bp, Homo sapiens
gccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggccgtcactaattagtattctcaagaatttcatttttcaattttaagaagaaaagggattttggtcacattttgcttgtaaatgaaaattacatcctcattctttgtgtagtatctacacattgttataagccaaaaaacaaagtctgtctggaatctttgtacatatttgtatgttgctataattgttatttttatcttcattattgtgcaaaatataaatgagcatttgtacattgactgtataagaaaccatgggccaggtcctgtggctcatgcctataatcccaacactttgggaggctgaggcaggaggattgcttcagtccaggagttcaagactaacctgggcaacatagccctcatctctacaaaaaataaaaaaattagttgggtgtgatggcatgtgcctgtagtcccagctactcaggagactgacatgagaggatcacttgagactgggagattctgaggctgcagtgagctgtgattgcaccactacactccatcctaggtgagagggcaagaccctttctcagaaaaggaaaaaaagaaattctggacatgtttttatcagttttcaggacttggtatcaatgtacatagaatggctaataaaaattggaattgagattattgaaaaaaa

SEQ ID NO: 71351 - DNA, 953 bp, Homo sapiens
gccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggcctgggctgtcttttcaactttagttttatttttatattttactttttagagacagggtttcactctgttgtccaggctggagtgaaactccatcttaaaacaaaca

SEQ ID NO: 71352 - DNA, 702 bp, Homo sapiens
tttttgagacagagtctcactctgtcgcccaggctggagtgcagaggtgcaattttggctcactataacctctgcctgccaggttcaagcaattcttgtgcctcagcctcccaaatagctgggactacaggcacgcaccaccacgcctgatttttatatttttagtagagacagggtttccccatgttggccagccattctctctttaaataatgcttttgcccattctatctctcatctactttcaggattcatatgtatatgtacatacatattagaacttctcactgtatcttgtattgaacttaccttctcctatattttcctctttcctgtttactctgaacattcccttttgacttacctttcagttagggaattctttcctctgcggtgtctaatttgctgctaaatccatctacaaaggtcctaattagaggggttgtatttttcacttctagaatatccatttttctttctcatagtttgtaactttctacaaaattcttaatcaggtcaaaattctcaacatagctattttaaatctgataactagaatatctagagttacccgtgggcctgtttctattctctattgtgtcacatatcttgtcatgtgcctattttgtgtgcagaacataaaatttgcaaaatcgtctgacaaaacatttttacatgtagaaactggtaattctccagaga

SEQ ID NO: 71353 - DNA, 258 bp, Homo sapiens
tctagagtagccttacctttattaggatacaaaaattggtaagcctgaagtaatctgccttttctttttctaaacggaacaaagctggatgaagaatgactttgacgagttgagagaagaaggcttcagacgatcaaattactctgagctacgggaggacattcaaaccaaaggcaaagaagttgaaaactttgaaaaaaaattagaagaatgtataactagaataaccaatacagagaagtgcttaaaggagctgat

SEQ ID NO: 71354 - DNA, 468 bp, Homo sapiens
ggccttggcccaaacaggaatgaggggcacagagtgcccgggtaaccgctcctgggagcagtggggaactgtcggatacttgaactctcaagagctgggctctgagcgtcctcgtccagcttgcccaccgccgggccgccctgctgcactatgagaacctgcccccactgccccctgtgtgggaaagccaagcccagcagctgggaggggaggctggggatgatggggactcgagggatggggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctgaaaaaaa

SEQ ID NO: 71355 - DNA, 2178 bp, Homo sapiens
gagggcttagctccgggcgggcggcggctgctgcagcgggacccgggagcggggcccggcgccgcccgggccgcggggcgatgtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtagggacttcccggtcctcaccaccctctgccccaccatgatccagcctctgcctcacactcctgtcctctgaacccaccctccccagggttcagggttgctttgcagaaggcatggaggtgggaccagatgcttccctgtgctggctggagtccccagagatatcagccaccgagtctcctggtctgtctccaggctggggagagaagggtgaccaggcgaggagggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctgaaaaaaa

SEQ ID NO: 71356 - DNA, 862 bp, Homo sapiens
gagggcttagctccgggcgggcggcggctgctgcagcgggacccgggagcggggcccggcgccgcccgggccgcggggcgatgtgagccccaggtgtatcccagagggatccgggtgacttctctgcagactgtttgccatgacagcccaccaaggacggggggaataaagtgggaacccttccccatgcccctcccacggtcagctccccgatggcctgggtgaggtcattcaagcttgggtggtgtcctcttcattctaggcacagtcctgactattgtgacatataatccaagtactggaatcctggaggggaagagccaaatagtaaggcctctggtctccccttcagaaaaagggaaggaaacccagcattttttttaaatgaagaaatatccacttgaggttattaaaactgcactgttttaaatgttcagtcttctgaatatatctttatgatcacaatgtaacaactcatttgaagaggacatcagaaagataaatttgcactggatgttgggatggtagtaagggagaagagagaacttggatgaagtggaatggatgagggcaggctggctgctctgacaccatggggagctgctgcagctgcctgaacagagacagcgttccagacaaccaccccaccaagttcaagagaaaacaaaattctgtatttgtgagttaatatacgtaaagtatttaaaatagtgcttagtggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggt

SEQ ID NO: 71357 - DNA, 520 bp, Homo sapiens
atctgggtcccgtcgaggtaccaacagctacaaatcaggacaggcaaccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71358 - DNA, 435 bp, Homo sapiens
cgcagcactgggagatacctacatggaattatccaaaattcttttcaattgaaaatgatcctggaaatggattaatgtagagatggccctgttttattttggtagaaagaagggctacacccctcttgatcttaacccttcaacctcagctcgtggatcattgtgtttgtgaaaccttttcttctcagattccaaactatacctccatgagctcctagaaggcagtgaaatctatctcccagaggttgtgaagcctccacgggtatgtaagggatatgtttgtgagagtggttattgactgagttgggcttatccatgatacactgaacttataaatcaacttttaggcttgaaaaattgtttttgaaatctttgggatctgggggagccagatattgtcctccccatcagctgtttggaaaattgagatcaaaa

SEQ ID NO: 71359 - DNA, 1472 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71360 - DNA, 1735 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggaaaaaaaaaacaccaaaagcaagaaaaaaaaagggggggccaaaaaaccaggggccatgcccattgaaaggcccaataaaaaaag

SEQ ID NO: 71361 - DNA, 1785 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtagggtggcattttacagtgtttccagtaacctgaggctattattaaaatttgtgggttaaaaagcta

SEQ ID NO: 71362 - DNA, 1731 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcttaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtagggtggcattttacagtgtttccagtaacctgaggctattattaaaatttgtgggttaaaaagcta

SEQ ID NO: 71363 - DNA, 1635 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaaggtgaggtactaggagatcaggcttctaaaaccttttcctgagatgggtcatgacactcaggcttgttgtttgactgaaacccagttggtgggggagccatgagataagagcacctcctagagaatgttgaactaaaggtgccctctctggctcctccccaaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71364 - DNA, 1137 bp, Homo sapiens
  misc_feature (1119)..(1120): n is a, c, g, or t
  misc_feature (1129)..(1129): n is a, c, g, or t
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaaacaaatnngagaagganggttggtt

SEQ ID NO: 71365 - DNA, 1264 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgctttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71366 - DNA, 1411 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttcttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71367 - DNA, 1780 bp, Homo sapiens
agcggcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcggtgagtaggcactgggcagggcagggtgccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttcccctcccccaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71368 - DNA, 1609 bp, Homo sapiens
aacagtttcaaagcactggagttacgactagtatgtgggtctcctgatacctttagcagtgctttacccctggaaccaatgattgtgatgtgctttctaacaagctgggaatatcattcttctcatttgatttttctgcttcagaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcggtgagtaggcactgggcagggcagggtgccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttcccctcccccaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggta

SEQ ID NO: 71369 - DNA, 1939 bp, Homo sapiens
cggcacgagaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaacattttaaag

SEQ ID NO: 71370 - DNA, 1885 bp, Homo sapiens
cggcacgagaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacacctaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaacattttaaag

SEQ ID NO: 71371 - DNA, 280 bp, Homo sapiens
gcaggaaaaagaaagaaaaggcatccagattggaaaggaagaagtaaaactgtcattattcatagacacggtcatctacgtaaatatttctttagaatctacaaaataagctactagaacgagtgcatttagcaaggttgcagcatacaaaataatgtataaaacgtaactgtatttctatatagtatcaatgaaccactaaaaatgtaaatttaaaatttctatttacaacattaaaaaatatgaaatgcttagggatatatctgatcaaatgtttaag

SEQ ID NO: 71372 - DNA, 384 bp, Homo sapiens
tatctccctatctctgtgagcatactcagtacggcaaaagccagggactcacagccgtggttggctataaaatttcccatatttgagactgtttaaagtcctaaagtggtcatttaatccaacgttcccaagtttttaatggccacagagacttccagttaaaaggaacaatactagaagccagatattctgactggaggttgacagaggttcagataggcagagttcaccttcatcacactctttttcccttctgttcacaagagaccctcaggggcaccactgaatatggtctgaaaaccacagctgtacctcgctcttatctccccaagtattgaacatacaacaggacaaacaacttgagatcagaaaaataaaataaaa

SEQ ID NO: 71373 - DNA, 998 bp, Homo sapiens
agcaatctgatcccataaatgagggatgcggagtaatgagcaggttctaaatgtcttacttccgagtggtataacatgagactcgatggcaacccttaaaccaggctgctttcaaatagtatgtatgttacatttatcttccttcaaacaaattcttttggcaatgtaaaagaaatcctgttttttttttaagggggtattttaagaaggtaattactatttccattttcaccaaaagcagcctagttttatttttaatgggtaaatgatgtaagaaccttaaaaaaccacatgaaacacagaggacaaagctgcaaaatgttcagtagtatcctcacttatttcgggtcagggcaataggtcctttttcacagttacagattaaactttctttgaaaaacacagtaagcttaagaactttgaggaaaaagaatgcactaaaacgctaagcagttacaaaaatgctcttttcatacagtttaagtttaatatgtgaagttgctctagtaaatacataaaaactcctcccttacatagtttcctgaagaatttttttgtccaatttttcacattgacttaagttacaaattgcagaggatagattgagggggactctgggtgggtgcaagtgcaggatattgagaaatcgcaagggcaaagttaaaatgattgaatacgtaccatgtgaagagtcaaggtgaggaaacgggacaaacgacatgtctagatcctgatgtcacttacttgtgttaaacacatgaatctactgccttttataaaatgtatgtgctgggtggttgtttttgtagattttttaaaatgcccaatattcattattcaagtttcaataagaatgattttgtttctacaaaaaggaaacaattttttaattttttatttggaaaaaaattaaatgtacagaaagttgcataaataatattgcaaataccatatatattaaggtaaacattaaaatattcctaatattttaaaccatt

SEQ ID NO: 71374 - DNA, 255 bp, Homo sapiens
tatttctggagttttgctgtaattttgagaggaaacagagtgtaagttgggcattctaaaaattagactgaactcacacataaatcatgaatctcaaaacttattcacaaacttaatatttttgtggcccatttcccatttttctctacttttcaccaccttaccccctttttttagacacagggtctcactctgttccccaggctggagtgtagtggtaagatagatggctcactgcagcctgacccactacag

SEQ ID NO: 71375 - DNA, 766 bp, Homo sapiens
aagggcagggagggacagcaaccactagaaggctgacatgggctggccctcttgttctatgaccccccatccgtagatcacttgccctgcaagagagttcagtatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatataccatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaactt

SEQ ID NO: 71376 - DNA, 197 bp, Homo sapiens
aaatgcacaataatgtgtcaagagccctggacttattgcttctcggacgttagcaaagatcaagcgcagaccactggctttggggtctgataccccaggagagtcccggtttcgtgctcatgtgttatgtgacccttgacccctcgttcaattctcacgtgcttcactctcctaagccatgcaaaagggacataagg

SEQ ID NO: 71377 - DNA, 1560 bp, Homo sapiens
  misc_feature (151)..(151): n is a, c, g, or t
agagtgggaaaaagcagaaggagaccagaggtgcccaggtagtgctgggcatgggcaggggcacagtgccacctgcaattgcctttgatgcctcttggtgccctgtgtttacttcttagacatctagggagtaaggtctggctctttcccntcttaacccaaggttggttgggactctgcagtctggccaagggatgtgttgtcctgtcccttctcccttaggtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71378 - DNA, 737 bp, Homo sapiens
ttccgcctgccccacccgtcacgctatcaaggacacccgcctgctatcagaaagccctgggggtctttttccctagtttatcaaggacctgtggaaacatttctctaactgaagataagaattttttttctctctctttctcctttctacttctagctgtctaaaccagagggttcctctcattttctttcagtaacaactgctctgaaaagaagatatttttcaacctgaacttgcagtagctagtggagaggcaggatacctccctcaacaatgggcattcctagggagcatcattaacaagattccagctctactccttcctgctgaggtttgtcgcttaagaatctggagacaggtagggtgcagtggcttacacctgtaatcctagcactttgggaggccaaggcgtgtagatcacctgaggtcaggagttcaacaccagcctgaccaatatggtgaaaccctgactctactacaaatacaaaaattagccaggcgtggtagtgtgcacctatagtcccagctactcaggaggctgagacaggagaatcacttgaaaccgggaggcagaggttgcagtgagctgagatcacgccaccgcactccagcctgggtaacagagtgagacactgtctcaaaaaaaaaagttttgcatgcggccgaattagggctccttggccaatcccctttagggggggggattttacgggccccggtttaccggggggcaggcc

SEQ ID NO: 71379 - DNA, 2558 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgaccggcagatgcatacaatggcaaggccacctgatacaccagtcctgttcatttggaaaagggacaactccttcacattcacaagctgggctgctgtctaaaccagagggttcctctcattttctttcagtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccggggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71380 - DNA, 1354 bp, Homo sapiens
acattccagttctgagttgagggcaaagattgtaatgggatgcttcagagaagccttggctcccaaggaggttataacttcaaagggtgtttttgaaaaaccaaggcggatgaggaaagtggctacaagttccttccatcacagaggatcaatgaaggggaacaaagatttgggagcatctactttgtgccagtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71381 - DNA, 1039 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggatacctccctcaacaatgggcattcctagggagcatcattaacaagattccagctctactccttcctgctgaggtttgtcgcttaagaatctggagacaggtagggtgcagtggcttacacctgtaatcctagcactttgggaggccaaggcgtgtagatcacctgaggtcaggagttcaacaccagcctgaccaatatggtgaaaccctgactctactacaaatacaaaaattagccaggcgtggtagtgtgcacctatagtcccagctactcaggaggctgagacaggagaatcacttgaaaccgggaggcagaggttgcagtgagctgagatcacgccaccgcactccagcctgggtaacagagtgagacactgtctcaaaaaaaaaagttttgcatgcggccgaattagggctccttggccaatcccctttagggggggggattttacgggccccggtttaccggggggcaggcc

SEQ ID NO: 71382 - DNA, 2305 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccggggccgaaggtgcgaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71383 - DNA, 2126 bp, Homo sapiens
acattccagttctgagttgagggcaaagattgtaatgggatgcttcagagaagccttggctcccaaggaggttataacttcaaagggtgtttttgaaaaaccaaggcggatgaggaaagtggctacaagttccttccatcacagaggatcaatgaaggggaacaaagatttgggagcatctactttgtgccagtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccggggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71384 - DNA, 1721 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 71385 - DNA, 713 bp, Homo sapiens
tcaagtaaaagatattttcatataagagaattttatgtattcttcttacttgattcatcaacagattatgaagcctagcagtgttctggcaaaacctttttaacttgcctagaacacagaagggatgttgccctttttaaggttgtagatcttttcagagtcactgtgggtcattctcaaccctttgcagttctgcaagctcacatatggtgcaagaggaaatgctggtatgactctgtgcattttcttgcccccaaacaggaacagttgatttcctacattaaatggaaggtagatgtgactatggaagagaagtacacaggggtgtttctgcatgtgaaatatttgtcataagttaaaaacccatcatggaataactgtttgttgtgatcagcatgtttttatcacacatgggcactggttttgtgagcacctggcttgatagtggtggggcggccaatgtgccagcgcccgcctactgagcattcatggacattggaaatcagcgaacaccacagacacaccgaatcagctgatgcacggtcatgttctggggtaaaacctgttcattatccatgtccacatttgtatagttatcactagactaaaatgaagatggaaataaatattttaccctgtgttcatgaaccaaatgtgtaccttcagagtctttttaagtaaaataaaaaaattattttggtgataattatttg

SEQ ID NO: 71386 - DNA, 451 bp, Homo sapiens
atactattactttatcggtagatgctttaaggttttccacatataagataatatcatctgtgagcagagatgattatacttcctttataattcaggtaccttttcctttttcactttcttttttattttggcctacttgttctggctaggacattcagtattatgttgaatagaagtggtaaaagtggataatcttgtcttgtactttatcttagaggaaaagctgtcagtttttcactgctgaatatgatgttaactatgaactttttatacatgtatttactatgttgaggtaatttccttctactcctggtttaagtgttttttgttttttgttttttttttttttaaatcatggaaggacttgggttttatcaaatgtcttttctgtatctattgagatgaccaatttgtattagtcagcgttcttcagagaaactgaaccaacata

SEQ ID NO: 71387 - DNA, 3271 bp, Homo sapiens
  misc_feature (1)..(1): n is a, c, g, or t
  misc_feature (3)..(5): n is a, c, g, or t
nannnccgccagccccgccagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgcccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaacgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaa

SEQ ID NO: 71388 - DNA, 2361 bp, Homo sapiens
  misc_feature (1)..(1): n is a, c, g, or t
  misc_feature (3)..(5): n is a, c, g, or t
nannnccgccagccccgccagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaaggtaagaagcgaagccaagagcgtcttcataagacgagcattaggtcttctggtcagttttctgttcctcttagtttccaacttgcatgtggcaaacaatgattattattgaactgggtttaaatgggatgtgcaccgtctgtgttttaatagaggcaccaatattatgagcattaaatgtcaaaatgagtgtaagagaaaccctcatgtgcatcagttataacataacggccccaggaaccagttccatgaccttgaatacgctcacctggagatgtagttggttcattaaacaagcacagtgtgtggcttaaaaatcaatcttctagctacttgggaggttgaggcaggaggattgaagttggaagtgtgaggtcagcctgggcaatgtatcgagacccctgtctccaaaacaataaaggggaaaaaaaa

SEQ ID NO: 71389 - DNA, 204 bp, Homo sapiens
acgcagatcacggcctagataacaaaagtgaagatcatgaacttaatggctgatttttcttctctttctttcttcccttaaactctgactaagaaatcaccatttgactgcagcaatttcgacaaagaattcttaaacgagaagccccggctgtcatttgccgacagagcactgatcaacagcatggaccagaatatgttcagg

SEQ ID NO: 71390 - DNA, 351 bp, Homo sapiens
caactcttttttttttaagtgtcaggaaactgaagcacaaaagatttaaatgtcacattaaataaatgctagaggtgggatgggaattcacatttttttcatttccaaactgatgttcgcttagatatgctcaaaggatttttagaaatgatgaattattgatggatgtcacactattgttgacttttctgatcaagagatttaaaattcaattctagcttgtacaaaagctttgaaattaattgcagacacctgtcaatgtctttgctctgtcccttacccgaggagattattgctaaacctctgttatttgtgttgctatcacattctgcccccagctggggtcgatgc

SEQ ID NO: 71391 - DNA, 1619 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71392 - DNA, 553 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccaggcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71393 - DNA, 1255 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71394 - DNA, 1354 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71395 - DNA, 774 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71396 - DNA, 1526 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccactctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaaaaaaaaaaaaaaaaaaattcgaaattagtttctctccgaaagaatggcggagggtgcaggctccggggtgcattgagtggtcgaggaccatctccgggagccgccgtggcggaccatcggtggctaaacaggatacgtgcgtgggccggaaagggtgggggctcgaacgctgtgaagggcgatcaacatttcttgggcaatttctacaggaaacaagtgttggaagtacctgggctttcctccggaaagcgggatgaacaccaaaccctttcccagaggccccttaccatttccggggcccccaagccggaatcttctggggggaccgtggcagaggtatgcgtgcgcccacaaaaaccaaggcggaggccaggccgctctgggaccggtctcaagggggttaggacgggaatcccaccggacctagggacaaggaaaaacggggaaggggggtaccctggtgccctcaaaggtcgtgcagtctgaagcctacaagaaaagttggccaaatcgggggacgcatggctcacgaaggtgggcttggaaagttcccaggcagttgacaagacaccccgtggaggagaagaaggaaaggaaaaagccaagatcccattaccggaagaaagaaccagcccaagaaggcaacggaaacaggcccgaaaacaccgtgcagaagaa

SEQ ID NO: 71397 - DNA, 1436 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71398 - DNA, 1318 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcacccggggacccagcgggacctgggcaagggcgcccggaacctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaaa

SEQ ID NO: 71399 - DNA, 972 bp, Homo sapiens
ggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaaggtaagcacccatcccatctctccctgggagaggcctccaaagccgggttcctcgaagcatgacgcatgggcccactggagcaccttcaccaggctgttacttagagatgcaggatctcagcctccttccacgcctactggattggaatctctggtggagcttaacaagccctgcagggaacctgacgcatgaccaaatcttagaaccttgcaaagtacacccgttgggtaaaggtgtacctgccttctcaaggccacctccccaccccaccccaaacccct

SEQ ID NO: 71400 - DNA, 422 bp, Homo sapiens
tattattataaggatttcagatctgagccagtttttagattcagaatgcactaactgaaggacaggtcaggtttccaagaaaagactctgcaacactatggcaggtatacatgcaaatgattctcccactccttctccaaatgggcctacagccactaactagggtgactgtacattggggaaagaggggacccaaacattatgaggaatgttgaccttagtgtccaagtggatgttgtcacccagagatctatagtgtcaccttgatcctccttctagactgaggtgtggaatttgaacatcttgctcaaagccatacagcttgtaaatggcagagctggggatcagatccagagttgtcggatttgagagtctttacttcgttttttgagactgggtgacacagcgagactctgtctcaa

SEQ ID NO: 71401 - DNA, 939 bp, Homo sapiens
tgttggtcttacttagtcatttgcagccaaacgcaaatgaatctcagacaaattctgcttgtcataactctattcattgtgctctttggcctaatcttatcattgttaatagttccgtatgattcagacactgatttggatactcgaggtcctctgactgagtttcctaaacaagaaatgatacttcacatgcctgaaaatgaataatctagaatatttcattaacattcagctgaccagttttaaataagagcagttgggattgcattcaattaaactggagtctataaggaacaacagttaaaaatgggaacagaggtatcccaagagaactcttactgctatagtatttgtgaggtcatgacagtattatcaacatctcgggacctattaatagttttgtcaagaagaaaagaaaatgaatagcctagttcagtaattcccctcatttggaaaggaatcaagaacccctttgtgattctgttgacagctatggtccctctcccaagaaaatgtctactttgcattcaatttcaataaatttccagaagccttgatgtgcatccacagggttctatgtgagaaaaccctcttcttggatgatttctaagtctacagtgttgtatacttcacaggaataaaaaatcaaccaaccagccgagcgcagtggctcacacctataatcccagcactttgggaggccaaggtgggcagatcacttgaggtcaggagttctagaccagcctggccaacatggtgaaaacccatctctactaaaaacacaaaaaaattagccaggtgtggtggcatgtgcctgtagtcccagctactcaggaggctgaggcaagagaatcgctggagcccatgaagcagaggttgcagtgagccgagatcacgccactgtattccagcctaggcaacggagcaaagctctgtctc

SEQ ID NO: 71402 - DNA, 358 bp, Homo sapiens
tgttggtcttacttagtcatttgcagccaaacgcaaatgaatctcagacaaattctgcttgtcataactctattcattgtgctctttggcctaatcttatcattgttaatagttccgtatgattcagacactgatttggatactcgaggtcctctgactgagtttcctaaacaagaaatgatacttcattaaataagagcagttgggattgcattcaattaaactggagtctataaggtaagagttttatttattcttttaattttttaaaatacaaaaaaaagcctgaagaatatgacttttctctgtgtcaaatgtgcaaaataacataaaaattttaaagaaaaacttagattta

SEQ ID NO: 71403 - DNA, 436 bp, Homo sapiens
tggtttgagaggtcggttcacaagacttctcttttcacacctgcgtggctcaggactgaggggtgcccaagatttgggacttccagttttatagccaggaaagtccttggaaagcccagctttctctctgtcctcgtccagaatgacttgaggtatatgaagaatccaggaggatggaagttaaattaaaatacacacaaataaacaagcaaactaccatcaaaaggcatgctcactgctgctggagcgaggttcacgggcacgcctagctctgcagccccgctggtcccccagtgccgagcacgaagagggcttctcagtcacactagccggtgaggaggagctggtcaggatgagtcccgacctgcaggcaccagctcccatggtgagtgtgagtcacacttgcccagcttcccctctgcccaggaaggcaccc

SEQ ID NO: 71404 - DNA, 492 bp, Homo sapiens
ttggagcttcctagaaattgttcatattccacatagtacagccataattttcactcactgaaaatgctggtaacaacctttgtcagcaagaggaggaaatagatttgatctatttattctctaaaattgtactacctgaaaagaatttctgagatacttagtattcctcatagacattctagtagttttgttaatatatgaatcacagggaaataatatgccatttctgggtagttctgaatttatataagttaacagtgagtaaaaaagatcaaagaattaattgtgacccttttcagcatgtattaaaatgaccttagatctttaaaaagtcagcagaattagagtttattaggttgattaaaagtcccttttaatgggacactttttaatgctttttctcctgcttagtgataactcagccttttattcatagactgtgctgtgtgacaagatgatggtttctataacatgtagtggccactcagaaac

SEQ ID NO: 71405 - DNA, 556 bp, Homo sapiens
  misc_feature (75)..(75): n is a, c, g, or t
  misc_feature (82)..(82): n is a, c, g, or t
gggggccccccccccccccaaagggccccccccacagtgctgtctgatctgtgctttccagctcaccccccacantcactcntgagacccttggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctta

SEQ ID NO: 71406 - DNA, 354 bp, Homo sapiens
  misc_feature (136)..(136): n is a, c, g, or t
  misc_feature (143)..(143): n is a, c, g, or t
aattcggcactagggggccccagtcagcctctctcccagtctacccagagaagccccttccccatgggatgacgaggccctcggccaagcccccacagtgctgtctgatctgtgctttccagctcaccccccacantcactcntgagacccctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctta

SEQ ID NO: 71407 - DNA, 1238 bp, Homo sapiens
  misc_feature (75)..(75): n is a, c, g, or t
  misc_feature (82)..(82): n is a, c, g, or t
gggggccccccccccccccaaagggccccccccacagtgctgtctgatctgtgctttccagctcaccccccacantcactcntgagacccttggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctccgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttaaaaaaaaaaaaaaaaaaaaaaacaaaaaaaaaaaaaaaaaaaaaaaacaccacgaagacaacagaaaccaaacaaagaaagaggggcccagcgacccgcaacaaccacacgcccctggggggcgacccgaacgaactaataggacggaagccccaaagctatgctagaacggaacggaggccaccacaaactaagagcaggtgcccacaactacacaccacacgacaggcacgagccagactagaccacacccaagtcgacgcgtggggaaacaccaacgactaccgactgccaccctcagcagcccaggccacaccccttcctcggggcagagcacagcgcgcaaggcacactccacagagaaatcagcccaccgcggctacataacaaatatctcggcggcttcttcggctccacacacggccaactacgccgccccagaaacaccatgcacctcgcactctattataacaatctaaccccgccgagaaatataagagcgacacgcagcaaagcgacgcacgtacaagcgaccagccagagagcggaaccacagtcgcaaccacgcacaacaagcgacgcacagccgcaaacacccaacagcagagcaactcaggcccatccgcatccgtgactcactgcgcgacaaccgcacacagacgacaataacaaacaacagcgc

SEQ ID NO: 71408 - DNA, 1597 bp, Homo sapiens
tattgcttgataataactataattactacaaggactgcctgagatgaaaaagacaggtgaaatcgaactttcacatggactggtgtctgagctggagagtctgtttgagtttgagtaggggaaagcctgaaaccccccaccacctgctcccgttagtccctgcattaactaggggcggactgggacctgatcctccaagctggaggcttgaaaactcaagggcaggcgcctggtccagcgattcggaaaccgagatgcaaagtcctcccgcgctcctagagaggacccggaagcgcggcgcggtcccggaagacgaggtggtgacacgcttccggcctttgtgactcattgtgtctgtgtcgaggcgtcgggagggcctaagtccgtgtgcggtgcccttcggccggcctgagcccagagtcagctcccctttctcgcccagcgcccccaggccgctcccggggctcacgagtcttgctctgtcgcccaggctggagtgcagtggtgcgatctcggcttactgcaacctctgcctcccgagttcaagcgatcctcctgcctccgcctcccgaatagctgggactacaggcatgtgtcccaaggcttggctgatttttgtatttttagtagagacagagtttcgccatgttggccaggctggtctcgaacgcctgatctcaggcagtccgccaacctcagcctcccaaagtgctgggattacgggcgtgagccactgtgtgcccagcctttgtttacattttcaagactatgccctggaaaaatactgggctgtttggaacacagcctttgagcttgtaacttcaagccgttgtttaagaaaatcatttctgtttatcctaggtgagaactgaggtatccttagctgctggaggtaattttatttaaagtggatggtatgtcagtatatttttcagcccatattcacccagaggtagtttcctactatctggaacccccaccctacccccatttgactgataaagatacaaaatgccagagaagttaaatacctctctcagggatgtgccacttacttgtgggagactagaattcagttattgcctgtgcagctttcactattacaggagttgtcccattgcttaatcttctaagcaggctgaaaattggaatgtacagttacatcttttaagcttattgaaaaaaattaagacatttctgtagtgcctactaaatgccaggcactattttaagtgctttatatctattacctcatttaatcctcacggcaactctatgggacaaatgctgatttttattcccattatacagatgaggaaactgacgcatagagaggttaacttgttgacttgcctaaggccgtcaactagtaaggggtggagcagctttaatgctaacctgatactcatccaactaggtccatggaacaaatttgagtgcaacattgaatgtagaatgatcgggcttttaaaaaatagtaacgttgtcaattcagtcaagtgtatttttgaaactgaggcttgcaaggaatcatgctaagtggtctaaggagtacaaagaggcctgctcttaataatctagctgatggaagaagaca

SEQ ID NO: 71409 - DNA, 672 bp, Homo sapiens
tattgcttgataataactataattactacaaggactgcctgagatgaaaaagacaggtgaaatcgaactttcacatggactggtgtctgagctggagagtctgtttgagtttgagtaggggaaagcctgaaaccccccaccacctgctcccgttagtccctgcattaactaggggcggactgggacctgatcctccaagctggaggcttgaaaactcaagggcaggcgcctggtccagcgattcggaaaccgagatgcaaagtcctcccgcgctcctagagaggacccggaagcgcggcgcggtcccggaagacgaggtggtgacacgcttccggcctttgtgactcattgtgtctgtgtcgaggcgtcgggagggcctaagtccgtgtgcggtgcccttcggccggcctgagcccagagtcagctcccctttctcgcccagcgcccccaggccgctcccggggctcacggtgagacttggggccggcctctggggtgggagggcggggccgcaagggtgtgtgcgcgagggtgggctccgcagctgcgccctgggaccccctccaggcggccccgctgttgtgcgaagagagtccatgcccctgcctcctggccgggcccggccgtagaaagcgccgttcttcctgggagacgtccccgccccacccccag

SEQ ID NO: 71410 - DNA, 297 bp, Homo sapiens
tcctagcctcgccagtgtcctagcctcgccagtgtcctagcctcgccagtgtcctagcctcgccagtgtcctagcctcgccagtggagaggaggccgtgacccttctagaagacttggagcttgatttatcaggacaacaggtaaaaagaggtgaaacctattatgtgtgagcagggcacagacgttgaaactggagccaggagaagtattggcaggctttaggttattaggtggttactctgtcttaaaaatgttctggctttcttcctgcatccactggcatactcatggtctgt

SEQ ID NO: 71411 - DNA, 370 bp, Homo sapiens
  misc_feature (266)..(266): n is a, c, g, or t
aatcgagctcggcctcattttattgacagacttggagcttgatttatcaggacacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgaggaatagtaaagaaacacatcataaaacctcccaggacataaaggtgagcacagancctgtttggatcaagtcagttcctggagcctgaatgatgactgctgaatcacgggaagccagggtctgtccccacagtctgcacaagagaaggatgtatcgtaa

SEQ ID NO: 71412 - DNA, 972 bp, Homo sapiens
gaggcgtctagaggacccctcacgccagtcacaaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagcaataggaaaggacaaaaaaaccatcacaggagagagaggtcacaagggagaaggggaaa

SEQ ID NO: 71413 - DNA, 1297 bp, Homo sapiens
  misc_feature (1193)..(1193): n is a, c, g, or t
tattgcttgataataactataattactacaaggactgcctgagatgaaaaagacaggtgaaatcgaactttcacatggactggtgtctgagctggagagtctgtttgagtttgagtaggggaaagcctgaaaccccccaccacctgctcccgttagtccctgcattaactaggggcggactgggacctgatcctccaagctggaggcttgaaaactcaagggcaggcgcctggtccagcgattcggaaaccgagatgcaaagtcctcccgcgctcctagagaggacccggaagcgcggcgcggtcccggaagacgaggtggtgacacgcttccggcctttgtgactcattgtgtctgtgtcgaggcgtcgggagggcctaagtccgtgtgcggtgcccttcggccggcctgagcccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgaggaatagtaaagaaacacatcataaaacctcccaggacataaaggtgagcacagancctgtttggatcaagtcagttcctggagcctgaatgatgactgctgaatcacgggaagccagggtctgtccccacagtctgcacaagagaaggatgtatcgtaa

SEQ ID NO: 71414 - DNA, 360 bp, Homo sapiens
aggtcttgggaaaactgaggccctgtgttctctcgtttgtgttgtctggaattctgtatttgggacctaaacactgaacagtgaacatgctggtgcaggaaggaacatgccccgagcccttctttgagcaaggctcagagcggagctgatttactcacagaccctttctcctcccccagctcttcctgctgcccacattcctgcaccccctcatgagggtagtcccagagaccaggcgatggcatctgcactattcacagcggattcccaggtgagctgtggcccctctgctctcctgagtcctcagtgtctgcctctgttcctgagctctcttcattatctccacaggccactctggat

SEQ ID NO: 71415 - DNA, 456 bp, Homo sapiens
cccaacctgtctgtcttcaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacagctaacacacagagagacaaaaccatcttatcagacagtaagcctgcatccgtcttacctgggaaatgcgctcccataattctcgggtaccgagct

SEQ ID NO: 71416 - DNA, 1615 bp, Homo sapiens
tattgcttgataataactataattactacaaggactgcctgagatgaaaaagacaggtgaaatcgaactttcacatggactggtgtctgagctggagagtctgtttgagtttgagtaggggaaagcctgaaaccccccaccacctgctcccgttagtccctgcattaactaggggcggactgggacctgatcctccaagctggaggcttgaaaactcaagggcaggcgcctggtccagcgattcggaaaccgagatgcaaagtcctcccgcgctcctagagaggacccggaagcgcggcgcggtcccggaagacgaggtggtgacacgcttccggcctttgtgactcattgtgtctgtgtcgaggcgtcgggagggcctaagtccgtgtgcggtgcccttcggccggcctgagcccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagcaataggaaaggacaaaaaaaccatcacaggagagagaggtcacaagggagaaggggaaa

SEQ ID NO: 71417 - DNA, 1731 bp, Homo sapiens
tattgcttgataataactataattactacaaggactgcctgagatgaaaaagacaggtgaaatcgaactttcacatggactggtgtctgagctggagagtctgtttgagtttgagtaggggaaagcctgaaaccccccaccacctgctcccgttagtccctgcattaactaggggcggactgggacctgatcctccaagctggaggcttgaaaactcaagggcaggcgcctggtccagcgattcggaaaccgagatgcaaagtcctcccgcgctcctagagaggacccggaagcgcggcgcggtcccggaagacgaggtggtgacacgcttccggcctttgtgactcattgtgtctgtgtcgaggcgtcgggagggcctaagtccgtgtgcggtgcccttcggccggcctgagcccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgaggtaagaagcaaggtttcatttaggggaagggaaatgattcaggacgagagtctttgtgctgctgagtgcctgtgatgaagaagcatgttagtcctgggcaacgtagcgagaccccatctctacaaaaaatagaaaaattagccaggtatagtggcgcacacctgtgattccagctacgcaggaggctgaggtgggaggattgcttgagcccaggaggttgaggctgcagtgagctgtaatcatgccactactccaacctgggcaacacagcaaggaccctgtctcaaaagctacttacagaaaagaattaggctcggcacggtagctcacacctgtaatcccagcactttgggaggctgaggcgggcagatcacttgaggtcaggagtttgagaccagcctggccaacatggtgaaaccttgtctctactaaaaatatgaaaattagccaggcatggtggcacattcctgtaatcccagctactcgggaggctgaggcaggagaatcacttgaacccaggaggtggaggttgcagtaagccgagatcgtaccactgtgctctagccttggtgacagagcgagactgtcttaaa

SEQ ID NO: 71418 - DNA, 321 bp, Homo sapiens
gctttacaaggctctgcctaacgaccttggaacttccatgaggtctttggtgaaagtcccctagttcttccccaggtagatgagttttcagtgggattcacatgccatgtgaaatctacgtgttggataattatgactgtgtctggtgaatatgaaattatttacagaccagatgttgatagtttctgactctgaatcacagcatagctgcaagaggtaaataaaaagcaagaggccgggagcggtggctcacgcctgtaatcccagcactttgggaggccgaggtgggtgaatcacaaggtcaggagatcgagaccatcc

SEQ ID NO: 71419 - DNA, 4651 bp, Homo sapiens
gaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctccttgggaaataatctgaaaggtctaaaaataaaaaagccttctgtgg

SEQ ID NO: 71420 - DNA, 4609 bp, Homo sapiens
acatatctgtccccacagtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggtgagagcagcctttctcagaggctccccaggtggtcctaggttcagatgggggtgcccaccccacgtggtgctcccaggagccgacggcctgtcctcagctcggtgctctgcccgcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgagtcccctcccctccaacccaggacaccctgacctctggagtcccccatcccaggcccctgtctcccaccctgctcattgtccacccaaggagttcctgtctcaacgccgtccctgcgaccgcctacaggtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctccttgggaaataatctgaaaggtctaaaaataaaaaagccttctgtgg

SEQ ID NO: 71421 - DNA, 790 bp, Homo sapiens
gaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagatggtcttactctgtcactgaggctggagtgcagtggtacaatcacagctcactgcagcctccaactcctgggctcaagtgatcctcccgcctcggcctccagagtagctgggaccacagagaagagctaccatgcccagctgatttttaacaatttttagtagatgtgaggtctaactatgctgtccaggctgatcttgaaatcctgggctcaagcaattctcctgcctaggcctcccaaagtgtttggattataggagtaagtcactgcacccagtctgaccttcactcttt

SEQ ID NO: 71422 - DNA, 597 bp, Homo sapiens
tgctcaccacttaggtccagtcatttcaaccttcccttccactcgcccctctcctccctggatgctacatgattttattcccttcctgccatcaaggtcccaccaaatgcccatccctgcagccgccctccaccccaagggagcagggttccctgagaacgaagggctgcttttcttggcaaaagtcaagaaagctctgttaaaaaataggcaaaggggctgctccaggtggctcacatctgtaattccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctccttgggaaataatctgaaaggtctaaaaataaaaaagccttctgtgg

SEQ ID NO: 71423 - DNA, 670 bp, Homo sapiens
ccatgtgggccaggatggtctcgatctcctgacctcgtgatccgcccccctcggcctcccaaagtactgggattacaggcgtgagccaccacgcctggctcatcacagcctctttaggcaactttaagagaatgaagggccttgttccaggcaaggggttagggaagctctgcccctgatgaggagaggacccagggtgtggagcctgactcccatcgccagactaggggcttaggggaggaagggttttgggagagtgagctcttgtggccaggaggccacggtcctggactccaggagtgtcacttggaggaccggtgccacctccttccccagagtgcccaagacaggagcaggacattgtgttcctgatcgatggctcaggcagcatctcctcccgcaactttgccacgatgatgaacttcgtgagagctgtgataagccagttccagagacccagcacccaggtgtgcctttgggggagggaggctgctgggggtgggtgcttcgatcctggtgaaatggcctcagccccagccctgtgtgcttctcccagttttccctgatgcagttctccaacaaattccaaacacacttcactttcgaggaattcaggcgcacgtcaaaccccctcagcctgttggcttctgttcaccagctgcaagggttt

SEQ ID NO: 71424 - DNA, 521 bp, Homo sapiens
ctatgttgcctgggttggtctcaaactcctgggctcaagcaatcctcccgcctcagcctcccaaagtgctgggattccaggtgtgagccaccacacccagactcaacaaatatttcttgtctccatacgccagagaatccaacagacagaaatcccttccacatggactttaaattattaaaatccatcttgcagatgaggaagctgaggctcagggagggaacgcaaacttgccggagtggcagctgtgctgcagcgtccacactcttacctaaagtgttctttgtctcctcgcagggtggtggttggagccccccaaaagataacagctgccaaccaaacgggtggcctctaccagtgtggctacagcactggtgcctgtgagcccatcggcctgcagggtgagtcaccgcccctcccgggacccagggccgggctcccaggcttccctgctccaggggcccgtggactcaccggagtgtcactttcagcttccactgtgtctgagaccctcaccctca

SEQ ID NO: 71425 - DNA, 3529 bp, Homo sapiens
gttctaagaaccgtaggaattcctctcctgagcatggctaaactctgagctaatagtatcattatatgaaagatgaggaaacggaggcacagacagattgagtccttgcccacggcctcgtggctcatacgtggaggagtcagaattggaactagagactgatcgaatgaatgacactcgggtcaccaggacacccttcctatctccactcttacatctgtttcttagcaatcatctcccaactcctacctcctcttttcaggttcttcttggtgacatctgttcacaactcaccccttctctccctttccgatggtcctacctccatattccccttgttacttatttccaacttcttcccctactttccatcttgattcacccttctctcctctggccagcggatcgcgggctcccagctctcctccaggctgcagtattttgggcaggcactgagcgggggtcaagacctcacccaggatggactggtggacctggctgtgggggcccggggccaggtgctcctgctcaggtgagagcagcctttctcagaggctccccaggtggtcctaggttcagatgggggtgcccaccccacgtggtgctcccaggagccgacggcctgtcctcagctcggtgctctgcccgcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgagtcccctcccctccaacccaggacaccctgacctctggagtcccccatcccaggcccctgtctcccaccctgctcattgtccacccaaggagttcctgtctcaacgccgtccctgcgaccgcctacaggtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctccttgggaaataatctgaaaggtctaaaaataaaaaagccttctgtgg

SEQ ID NO: 71426 - DNA, 2706 bp, Homo sapiens
gttctaagaaccgtaggaattcctctcctgagcatggctaaactctgagctaatagtatcattatatgaaagatgaggaaacggaggcacagacagattgagtccttgcccacggcctcgtggctcatacgtggaggagtcagaattggaactagagactgatcgaatgaatgacactcgggtcaccaggacacccttcctatctccactcttacatctgtttcttagcaatcatctcccaactcctacctcctcttttcaggttcttcttggtgacatctgttcacaactcaccccttctctccctttccgatggtcctacctccatattccccttgttacttatttccaacttcttcccctactttccatcttgattcacccttctctcctctggccagcggatcgcgggctcccagctctcctccaggctgcagtattttgggcaggcactgagcgggggtcaagacctcacccaggatggactggtggacctggctgtgggggcccggggccaggtgctcctgctcaggtgagagcagcctttctcagaggctccccaggtggtcctaggttcagatgggggtgcccaccccacgtggtgctcccaggagccgacggcctgtcctcagctcggtgctctgcccgcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgagtcccctcccctccaacccaggacaccctgacctctggagtcccccatcccaggcccctgtctcccaccctgctcattgtccacccaaggagttcctgtctcaacgccgtccctgcgaccgcctacaggtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccag

SEQ ID NO: 71427 - DNA, 149 bp, Homo sapiens
tgtggatggatgtggaggtctcccacccccaggtacccaaggactgcatgtggctcctccacgaatgccctttctacctggattccttgtgccccatgtgggtccctgatgtcccagctgagacacttgttctctgcattttcccccag

SEQ ID NO: 71428 - DNA, 186 bp, Homo sapiens
gtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccggtgcgtctgggcatgaacgtgggtggcggcc

SEQ ID NO: 71429 - DNA, 1688 bp, Homo sapiens
gagatttcctcaggaggtttcttgaagcttatcaggtttacagaccataacatactctttgctgattcatatagcaatgaatgataaaatcagaggcacttggtttgggcacttaaaggaatgttttcatctcttctcccagttgaggccatgactttgaagaaaggttaaaatggtttgagtatcaagtagcatcctacaaaaggatctaaaactagattttctagtttgctcagttaaaatgataaaatgagataattggagactatcagttgtaaatctgagttagaaataacacggtagctgaaaaaaatgtcagtgattcacaagaaaaaataagaaaacaacattacttcagttttgcctcagaaaagttaaatgattttttaaatagaaaaaaatcgccctcaagtttgttcctctagtgcctatggtactttgaaaaggatctctttttaaaatgttaaaaggtaattaactttgtttcagcagcatctctcaatcacatataccccataaatatgtacaactattaaaggacctataatgataattaaaaataaaatattttaaaaatcttttataaacaatttttaacactcatacctttttactagggcagataaaataataaggtgaacctgaagtataatggaaatagataaatataatcttaggcagggcaaacttgctgagataaagctaattgctggaatatgccaatgggaagttgatatggtttggatgtttgtcccctccaaatctcatattgaaacgcagtccctggtgttggagctggggcctggtgggaggtgtttggatcatgagggcggatccttcgtgaatgacttagtgccatccccttggtgatgagtgagttcttgctgtgagttcacaggagacctgcttgtttaaaagtgtgtggcacttccccccctcactcttgctcccactctcgccatgtgatatgcctgctccccttcttcttctgccgtgattgtgagcttcctgaggcctcattagaggcagatgttctgtatggcctgctgaactgaggtctattataagaactccctgcccatccttttaacaagaggcttagaaagagacatgccaaaaccacctccaaaaaccaaggtaaactatgttttctctgtaggcgaccatgcagttgactcacaagcacattacttttctgggaagaaacttttaagtggagaaaccttctactcctccacaatgaaaagaagctgtccagtaaacgaaatccctcctgcttcatgtccacttagcatggcagataattcgtactctacactctcctgtggaacagagagccttacagcttactgttgtatcatcacagttctatgatggcaatgtataaaaattaagattgaggcatgatattttaatgtcttttttattttcagtcacattaatttatcagggttaattagtgcctggtatcacatattttttttttttttggtgatgggttccttattcaatttttaaagattagaccatcttaaaatatttttagtgttgactgtgacaatttgttttttggctttcaaaacaaattattgtgtgttttaagtatgatgaccctagttttattggaggtatatatctacctccttttgcttttttatttgctaaactagctcatactgtatctcata

SEQ ID NO: 71430 - DNA, 1088 bp, Homo sapiens
gagatttcctcaggaggtttcttgaagcttatcaggtttacagaccataacatactctttgctgattcatatagcaatgaatgataaaatcagaggcacttggtttgggcacttaaaggaatgttttcatctcttctcccagttgaggccatgactttgaagaaaggttaaaatggtttgagtatcaagtagcatcctacaaaaggatctaaaactagattttctagtttgctcagttaaaatgataaaatgagataattggagactatcagttgtaaatctgagttagaaataacacggtagctgaaaaaaatgtcagtgattcacaagaaaaaataagaaaacaacattacttcagttttgcctcagaaaagttaaatgattttttaaatagaaaaaaatcgccctcaagtttgttcctctagtgcctatggtactttgaaaaggatctctttttaaaatgttaaaaggtaattaactttgtttcagcagcatctctcaatcacatataccccataaatatgtacaactattaaaggacctataatgataattaaaaataaaatattttaaaaatcttttataaacaatttttaacactcatacctttttactagggcagataaaataataaggtgaacctgaagtataatggaaatagataaatataatcttaggcagggcaaacttgctgagataaagctaattgctggaatatgccaatgggaagttgatatggtttggatgtttgtcccctccaaatctcatattgaaacgcagtccctggtgttggagctggggcctggtgggaggtgtttggatcatgagggcggatccttcgtgaatgacttagtgccatccccttggtgatgagtgagttcttgctgtgagttcacaggagacctgcttgtttaaaagtgtgtggcacttccccccctcactcttgctcccactctcgccatgtgatatgcctgctccccttcttcttctgccgtgattgtgagcttcctgaggcctcattagaggcagatgttctgtatggcctgctgaactgtgagtcaattaaacctctttttgaaataaattac

SEQ ID NO: 71431 - DNA, 1619 bp, Homo sapiens
gtgtcagtattttcacctttgtgtaatccccttccctagaatatccactggatttagtgattcagtactgacaagtttggtagaatgcagcatagtgatgggatatcaattgtgatattaaattaaaaggactacagcaccactacacacctattagatctaggccagaatctggaagactgacaacaccaaatgctgatgaggctgtggggaaagaggaactcttatttattgttcgtgggaattaaaaatggtgtagccactttggaagacaattcgactattccttgcaaaactattcaatctagcagttgcactccttggtatgtaacccagaaagctgcatgtattacactcctcagtatgtaacccaaaaagctgtggtatgtctacacaaaaagctgcacacagatgtttatagtagctatattcataattgccaaaaattggaagcaaccaagatgtctttcagtaagcgaatgaataaataaactgtggtacatttagacaatggaataatatccagtgctaaaaagaaatgagctatcaagccacgaaaagacatggaggaaatgtaaatacaattactaattgaaagaagccaatcttaaaaggctacatgtatgattccaactatatgacattctggaaaatgcaaaactagggaagaagtaaagaagataagtggttgctaggggtcggggagggagagataaataggtggagtatagaggattttttagagcagtgagactactctgtacagtactataatggtggacacatgtcattatatatttgtccaaatccatggaatgtacaataccaagagtgaatcttaacgtagattacagactttgggtgataatggtatgccaatgtaggccttctgcttgattttgcggtgaacctaatattgctgtaaaaaacaaaatcaatttttaaaaaatgacagctttttattgggtattctgtctctatctcactctcttgtcctggggagtgagcttggaaccaaatttcccccagttgaaccagaaaaaacagagaaataagtgtttgtcatttttagctgctaaattttggggataatttatcctgcagttacatataactaatatacatgatatatctacatatctttttctacccttctgttttcagattatgttttctctttttaatccagactgacaatttctgcctctaactggattgtttagtccatttacatttaatgtaattactaatattacagggttgaatttaaatctaccatcttggtatatgatttctatctgtcccatctgattgttgttcacctgtgtctttcttcctgttttcccttggtgaatgcagtaatttttagtattccatttagtataagtgtacatatttttagtatttattttttatctcccctgttaacctcttctgtgtcttgtgtgagtttgtgtggtttttctaggaattgcaatatgcatccttgacatatctattgtctcatgaaggatgtaagatattccaaaagtgtaatttccttaaccgactttcctggcccttatgttcttgtcatgtattttatttctatgtataacactataatacatatattgtta

SEQ ID NO: 71432 - DNA, 1565 bp, Homo sapiens
gtgtcagtattttcacctttgtgtaatccccttccctagaatatccactggatttagtgattcagtactgacaagtttggtagaatgcagcatagtgatgggatatcaattgtgatattaaattaaaaggactacagcaccactacacacctattagatctaggccagaatctggaagactgacaacaccaaatgctgatgaggctgtggggaaagaggaactcttatttattgttcgtgggaattaaaaatggtgtagccactttggaagacaattcgactattccttgcaaaactattcaatctagcagttgcactccttggtatgtaacccagaaagctgcatgtattacactcctcagtatgtaacccaaaaagctgtggtatgtctacacaaaaagctgcacacagatgtttatagtagctatattcataattgccaaaaattggaagcaaccaagatgtctttcagtaagcgaatgaataaataaactgtggtacatttagacaatggaataatatccagtgctaaaaagaaatgagctatcaagccacgaaaagacatggaggaaatgtaaatacaattactaattgaaagaagccaatcttaaaaggctacatgtatgattccaactatatgacattctggaaaatgcaaaactagggaagaagtaaagaagataagtggttgctaggggtcggggagggagagataaataggtggagtatagaggattttttagagcagtgagactactctgtacagtactataatggtggacacatgtcattatatatttgtccaaatccatggaatgtacaataccaagagtgaatcttaacgtagattacagactttgggtgataatggtatgccaatgtaggccttctgcttgattttgcggtgaacctaatattgctgtaaaaaacaaaatcaatttttaaaaaatgacagctttttattgggtattctgtctctatctcactctcttgtcctggggagtgagcttggaaccaaatttcccccagttgaaccagaatatcctgcagttacatataactaatatacatgatatatctacatatctttttctacccttctgttttcagattatgttttctctttttaatccagactgacaatttctgcctctaactggattgtttagtccatttacatttaatgtaattactaatattacagggttgaatttaaatctaccatcttggtatatgatttctatctgtcccatctgattgttgttcacctgtgtctttcttcctgttttcccttggtgaatgcagtaatttttagtattccatttagtataagtgtacatatttttagtatttattttttatctcccctgttaacctcttctgtgtcttgtgtgagtttgtgtggtttttctaggaattgcaatatgcatccttgacatatctattgtctcatgaaggatgtaagatattccaaaagtgtaatttccttaaccgactttcctggcccttatgttcttgtcatgtattttatttctatgtataacactataatacatatattgtta

SEQ ID NO: 71433 - DNA, 2726 bp, Homo sapiens
caacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacagaaaaaaaaaata

SEQ ID NO: 71434 - DNA, 808 bp, Homo sapiens
tgagaatactaagcgcaaatcaggagttctaatgtattcacagctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatttgttgttttaccctattttgggtataggactatcgcgactatagagaaggagttccggaattgggtacagagctgcgtttgcgaaacagggttttcttttttcacggcccctaccgtctggtacccttgggaaccctgtggtctgcgccacctcggggtgtcgcttccggttatcgcgctgggggtcca

SEQ ID NO: 71435 - DNA, 389 bp, Homo sapiens
aattggtattagttgtcatagttattaatgttggaaggtgttttgcctactttagttggcaaaattttttgaagatttttgaaattgctttcaaaaacattttaagaatgaaaattggtcctacttttttgctttgacctcaaacgcagttatccagcttgatcatctgctttattcattaaccttgtctccaaaaattaaattggttcaattctgtactaaaaaatgtagtctcccaagcccctgattccctgttgagtctggttttaaaaaaaactgttgactgtgctcagaaattccaggtagaggcaggaggaactggttgcttggcctctcagtatatacccccggaggctaccatgtgtctccccatcgcccacgtgcatggg

SEQ ID NO: 71436 - DNA, 202 bp, Homo sapiens
gcaaagcaccaagtgacacttaggaatattttagacaagagagcttggttcatgattcaacattagacagatattctggcacaaatatgaagaaccctcaattttcccctgtgggtcagccacaagaccagggcaatttaacgccttgtctcatccacctcccagctggctgctacctcctgcccctctttgagccctgtgg

SEQ ID NO: 71437 - DNA, 360 bp, Homo sapiens
attcccccaggctctcttgcctcgcgtctctctcttacggagggctgtgtgggttctcagtggtcatcttctccagcctggctcatgttggggagcaaggtagctggagctcctgggagtccatagcactgggcatagaatgggacagacttcccctgtccacgttgcttagcagcccatacaggtgagcacctggggaacagggagttgggaagcatctcttatagaaatgaacctaaagccatttctgcctcagccttttgctttgtttttaagtggcctggtttcctcactgcttctgggacatccagctgaactttatctctgtttactatgcctcactattgttagaagctacaa

SEQ ID NO: 71438 - DNA, 584 bp, Homo sapiens
aaataccgcatgttctcacttgtgagagctaaacattgagtacacatggatacaaagaagggaacagacaccagggcctacttgaggggggaagaagagaggggggcaaggttgaaaaagtattgagtactatgctgagtacttgggtaacaggatcagtcataccccaaacctcagcatcacacaatacacctaggtaaaaagcccgcatatgaacccctgaatctgaaataaaagttgaaattatattttaaaaaatgtggagaatttgaatagtgcaaggaatgtatacagaaaacagtgtctggagaatgcctgacttagtttgccaaaaaagtgtcggctccgctgccttgcctccagtggattacccctaggatgatcttatttccctttctgtttagattcagggaagtactgagcatcagcgtcttttccgtgtggctgttactgatattgttacagtttcataaagaacaatacttatcataccttaggccaaatgttctccaaaacaaaaaaaaagtaaatagaaacttccagccctgacaggtattcaagcctaaagtatgatacagagaaac

SEQ ID NO: 71439 - DNA, 355 bp, Homo sapiens
attattttgcatgttctaggtagactttttagtcctatctgtaagttacaattttttcctaagccaaaatctgtttctcttaattttattactctaatttttgaccaaagtctctagaataatttccaaattgaaaatattataatatttttctcagtataatttgaattattctagtgttttaccattaagtatggtgtttgctgttttgttttacatagaaaattgaggacattactttttgtatctagttttcctttatttctagaattaggaaaaatcaggccaccttccctcaagtctccattttgaacttctgcagtgtctaggtttcaggaacaggaatgggggatag

SEQ ID NO: 71440 - DNA, 579 bp, Homo sapiens
aagcaggaatctgatggacatattatgtcaattactcatttgaatccatgactcagagtattttaaatatacatatggaaaccagagtcttttcataaccagactctacaaacaagaaatgtgtgccaagacgtgacaaacacaatcttaaaaagcttcacagatttaaatcttccatttaaagcacaacttattttatcaatgcttttatgtaatccccaaaatacagcaacactgagtttaaaattccaaagatgttttctggtttcaatgatggaaattgcttgtcctgtctacaataaacacacacagtaggacacaaaacttcaaagagaaaattcatatattgatggagacaatttttgaaattttcttgtcatatatgaaaagcaatttgtgatggatatctccgggccacaacttttcttttttttttttttgagatggagtctcagtctgtcacccaggctagaatgcagtggtgcgatctcagcccaaaatcagagaaatttatatccagcttccccaggaggctaaagcaaattttttggaataatttttgtctctttgttaaaacaa

SEQ ID NO: 71441 - DNA, 378 bp, Homo sapiens
ctatatgatcttggcatgccgggatattagggcaaaaacaaaccttctgtaattgaaaactgtgaagtctcatatttagtttaaaaatataattcaaggttgggtgcagtggctcacgcctgttatcccagcactttgggaggccaaggcgggcggatcacgaggtcaggagatccagaccttcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagtgagccgagatcgcgccactgcactccagcctgggcgacaaagcgagactccctctc

SEQ ID NO: 71442 - DNA, 485 bp, Homo sapiens
agattagtggtatggataatgctataggagatcagagagaggtgctcactgtataccagagtattaaaggtgtcagggaggaagtaatatttgagatttaattctaagaatgggttggatttgcattatcttgattagaggagctctgagtatttcagaacctaaggatggcttaaaattggaaatgagcattttgtttataggaaaacctagtaaagccttttgtgtacttcagccctcattgatctccctctggatcgtctgtctatttttatagttttatggttaataccattgtatgttactatatttctttttgtttattattttatgtagaaattttgtgtactgtaatctcacccagtcctcataataatcattgcacaggtgaggcagtgggaggatcatagggaccagagaaaacttgtaattgtccatggtctcaaggctaaagtggtagagctgagattcaagcccaggtttta

SEQ ID NO: 71443 - DNA, 667 bp, Homo sapiens
cggaaatctgggcagatttgggatctagagcagggaggtctcagggttgaggcctgaagtccagcacggcacacagcagggctgagagcagaatccagggtcatgtctgattcccaggccggttaccgcctctctgaccccagatgtctcacctgtcgaatgggtacattcgggaacagcacccactctacgaagccaccatgaggacgaaagagaagggtcactgagcaggtttttttcagctctgagcagctctcctttttcagctcttgccgcatctcggactgtcccaatgacagccgtagcaagaagagataagaaacaagacaagttcatgttgtccagttttgaggtcttgaaagaagttgcaccagtatgagaatagtggatcagttttctctaggatccagaaagcatatcaggcagccttggggtgaggaaaggagcccggcctctccagcagccacacaggcctgcagtaggatggggttggggctggccatgtggatcacttgggcctcatgaggggaaaggaaataccagggggcagaggaggagcatgggggcagctggttgcctaaggagaaggcacctcagggaaggggactgtattcgtttgttttcacactgctataaagaaatacctgagattgggtaatgtaaaaag

SEQ ID NO: 71444 - DNA, 744 bp, Homo sapiens
  misc_feature (2)..(2): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (88)..(88): n is a, c, g, or t
gnaagnagaangntaaaacagggcagattattatgtagcagctatttaatagacaaataagtgtaagttgatggaaagcagtaatgtnccttaatacagacacttgcacttggtagacagattcacccaagtttgcatattataattccagccaccacacagtgagtgagtgactctttctcacaatatcactaactctaagtctctgtctctcatcacatcctatattctcacaccacccctgagccctaggggacatgatgcctacccgatcctgccggctgagagaaggatggtatattttcttacattagtcaggagctggttggagaagatgaacgtagacatacatgaagtggcacgaaaacaaaggtgatataaggaccacctcctgcacaaaacagaactgagaaaaggggaagacttgtttactcggattaggtaggatatacacgaatccatctcacaccagatattcttctgctgtagacttccaagtgtttcagtccaccattaatcatggactctcacaattagcagagatgcagagtgacctaatccaacatcccagctgaaacgtgaacaaaccaccctcccaaggaatttgtccacccaccaaagctgttttccaatgtgacttaaccttgggcacatgtccccacccccaaaggaagcaaccccttccatctttgggttaatgttggcttccttctaaaatgaattggctcaatttctctgttgagt

SEQ ID NO: 71445 - DNA, 452 bp, Homo sapiens
gctaagaccacagagagtcttgtatggtataataggaaagagtgagggatttggagccaggtgacatgggtttaaataaatactgccaatccttgctgtgtgatcttgggcacatcatttatactctctgattgtcaatttcctcctgtacaaaatggagataattcttatggtatgtggttgttaggacaaagtgaagttatacaagggaaagttttgtttaaattgtgaagggttatataaatattattattaggcgccctgaacaagagtgcttgcatgctgacaagggcaacctggagggtgtgttggaaacacatcatgtctgtttctatggcagttctgcctcatgtaaggtgctgccccatcatgagcccacatgttatacctactcagaaatgagtaatacagagcttgttttgattatgtaggtttccgagaaaaaagggaaa

SEQ ID NO: 71446 - DNA, 402 bp, Homo sapiens
tttactataacgttaacagtaattatttaaattattagcacatggacactgcagcgtaggatcaaaatgcattcaaacaacgggatggaatttattgccaacaaaatataatactaaaatcagttttgcacttccattgtttttttacacatgtcttcacacggacattttcatgtttcttcccaagcttttgccttccttttcacctaattctttgtcatttttgttgctgttggggtcttgcataagcatgctgatgttttgtaagatcagcccgctgtcccttatgatgattcccttcagaattggtgcattcaatgtctttggcagaaaatcctatgtaatactggcttgtgtgttaagctcattcccatcatcatcaattggagacgcttacttaag

SEQ ID NO: 71447 - DNA, 1474 bp, Homo sapiens
tttttgcattctatacattcataggttttatttcagaaacgagttcttgtcttcatgtggaactggaacaactgacgaccctaccacatgtttgtatttataagggttttctcccttgaatcctttcatgttttcaaagaaatgaaaaagctgaaggcttgactatgtttcttaagattatgtagtttttctacgtattaaaattcaactatgcctttgaaaagatgtgggaaaatcaagttcattaacacgttttttacattcattattttttccaatacaagtttttctaagttttcaaagagaactgggaaagttgaatgctttcttgtgtttctttcatcgatagggttctgtacagtgtgagttcttttatgtgttctaataaactagagcatatgacggctttaccacatttcttacatgagaataatgtttttgaagatagcccagttgactaacattgtcctgtgttggttttgttgtgtttctccttccccaggcttgagttgggaaaccagttctcccacttcattaataatgatgtcgatgttcctggcagtgtttataccaaatgctactttgacctttgcgccttggcacacgacagtagcctatatttgccattttgtcttcttgacatagaaagagcatgggaactgaaggttgtttcaaggttggaagacaaagacttctatggtactgccaacaaaaggaaaaggtctttgagttctgatgatttaattgatcttcagtgccttaaggccatcctctcctgaaggaagaagtgaggggttatataacatctgaacccctcatcaaaaaagacaggaaaatatcacctttcctgctgaagaactagaaaagtactttcaaaagaagaaacacctacaattcaagttaactcaaggacaactaggattgcacttcatagaaaagaatgggaccttgtcaatgcaacaacacactcttacactcttctgtcccttttaatgtaaagagagttataaaaaccactccaaagtgaaggctcctatgtgagctgatagcagtgaactatgtaagggtttaaaacaatggtttaaatttttagattttaaagataacttttctgtttcttttatatttttctttcccccaatattgctgcatatgcatttagcatcatattaccattaaaacataggactcttaacaactcataaagccactaggagcagatgcagcattgtcaggtactgaaggggctcttccttcctactcttagaatcgaagctactagttactggcaatcattttaagcaaaagcttctggataacatttgccattcatatcctctgtaagcacttcttattagcagttagcatgtttggggtcataaaaagagaaaatattggttattgattatctacttttattagggtctgtggtgtatttcttgtgaactataatggttctcatttgctgataaat

SEQ ID NO: 71448 - DNA, 426 bp, Homo sapiens
gctgttcggcttggaccaacctgggcagcgtgagccatctggatcagagccaccaggggaagggggcagcctgcccacacctgtggtcctgtgaacggcctgcacggccagtggcccagcggagcggtactgtttatggcacaatgcacacaggccagcaagtggctttgatgtggcccttggaggggtggagacgagcccattacaggaacaggcgtagggcctcgtcacctcttacccaagatgttcttggaaatgctcttgctctgagtgaagattaggaaaccgtcttctattttaggagcctggtgtatgttacatactgtgttgactcgcccatgacagttgtgtgggtcctttgaaaggggtgtgtcagtgggggagaacttgacaccccatggggaggggcaactcggggatgctggg
